(12) United States Patent
Gu et al.

(10) Patent No.: US 9,856,315 B2
(45) Date of Patent: Jan. 2, 2018

(54) METHYLATION AND ACETYLATION SITES

(71) Applicant: Cell Signaling Technology, Inc., Danvers, MA (US)

(72) Inventors: Hongbo Gu, Princeton, NJ (US); Ailan Guo, Lexington, MA (US); Daniel Mulhern, Beverly, MA (US); Jeffrey C. Silva, Beverly, MA (US); Jing Zhou, Beverly, MA (US)

(73) Assignee: Cell Signaling Technology, Inc., Danvers, MA (US)

( * ) Notice: Subject to any disclaimer, the term of this patent is extended or adjusted under 35 U.S.C. 154(b) by 0 days.

(21) Appl. No.: 14/884,327

(22) Filed: Oct. 15, 2015

(65) Prior Publication Data
US 2016/0137725 A1    May 19, 2016

Related U.S. Application Data

(60) Provisional application No. 62/064,253, filed on Oct. 15, 2014.

(51) Int. Cl.
*G01N 33/53* (2006.01)
*C07K 16/18* (2006.01)
*G01N 33/543* (2006.01)

(52) U.S. Cl.
CPC .......... *C07K 16/18* (2013.01); *G01N 33/543* (2013.01); *C07K 2317/22* (2013.01); *C07K 2317/24* (2013.01); *C07K 2317/31* (2013.01); *C07K 2317/54* (2013.01); *C07K 2317/55* (2013.01); *C07K 2317/622* (2013.01); *C07K 2317/626* (2013.01); *C07K 2317/76* (2013.01); *G01N 2440/00* (2013.01)

(58) Field of Classification Search
None
See application file for complete search history.

(56) References Cited

PUBLICATIONS

Guo A. et al., "Immunoaffinity Enrichment and Mass Spectrometry Analysis of Protein Methylation", Molecular & Cellular Proteomics 13:372-387 (2014).

*Primary Examiner* — Jacob Cheu
(74) *Attorney, Agent, or Firm* — Scully, Scott, Murphy & Presser, P.C.

(57) ABSTRACT

The disclosure features over 5000 methylation and acetylation sites identified in human cell line, human serum and mouse tissues, peptides (including AQUA peptides) comprising a methylation or acetylation site of the disclosure, antibodies specifically bind to a methylation or acetylation site of the disclosure, and diagnostic and therapeutic uses of the above.

10 Claims, No Drawings

METHYLATION AND ACETYLATION SITES

FIELD OF THE DISCLOSURE

The disclosure relates generally to arginine and lysine methylation and acetylation sites, methods and compositions for detecting, quantitating and modulating the same.

REFERENCE TO TABLE

This application contains references to two tables ("Table 1" and "Table 2") which are being submitted concurrently herewith as the text file "CST335Table1.txt" and CST335Table2.txt, file size 471 kB and 50 kB respectively, created on Oct. 14, 2015. The aforementioned tables are incorporated herein by reference in their entirety.

BACKGROUND

Protein methylation and acetylation are common post-translational modification that mostly occurs on arginine or lysine residues. Arginine methylation has been reported to regulate RNA processing, gene transcription, DNA damage repair, protein translocation, and signal transduction. Lysine methylation is best known to regulate histone function and is involved in epigenetic regulation of gene transcription.

Protein methyltransferases and demethylases have been implicated in human health and disease (Greer, E. L., and Shi, Y. (2012) *Histone methylation: a dynamic mark in health, disease and inheritance. Nature Reviews. Genetics* 13, 343-357; Yang, Y, and Bedford, M. T. (2013) *Protein arginine methyltransferases and cancer. Nature Reviews. Cancer* 13, 37-50). Considering the important biological roles of protein methylation, there is a need for identification of additional methylated proteins and methylation sites.

SUMMARY

The disclosure features in one aspect arginine and lysine methylation sites found in human cell lines, human serum and mouse tissues (Table 1) and lysine acetylation sites found in human serum (Table 2). The sites occur in proteins such as: secreted proteins, adaptor/scaffold proteins, non-receptor ser/thr protein kinases, non-receptor tyrosine protein kinases, chromatin/DNA binding/repair/replication proteins, cytoskeletal proteins, mitochondrial proteins, transcriptional regulators, translational regulators, ubiquitin conjugating system, cell cycle regulation proteins, RNA processing proteins, adhesion or extracellular matrix proteins, proteases, kinases, apoptosis proteins, chaperone proteins, receptor/channel/transporter/cell surface proteins, enzymes, G proteins or regulator proteins, Endoplasmic reticulum or golgi proteins, calcium-binding proteins, vesicle proteins, motor or contractile proteins, non-protein kinases, phosphatases, and proteins of unknown function.

In another aspect, the disclosure features peptides comprising the methylation or acetylation sites of the disclosure, and proteins and peptides that are mutated to eliminate the methylation or acetylation.

In another aspect, the disclosure features modulators that modulate arginine and lysine methylation or acetylation at a methylation or acetylation site of the disclosure, including small molecules, peptides comprising a methlyation site or acetylation site, and binding molecules that specifically bind at a methylation or acetylation site or acetylation site, including but not limited to antibodies or antigen-binding fragments thereof.

In another aspect, the disclosure features compositions for detecting, quantitating or modulating a methylation or acetylation site of the disclosure, including peptides comprising a methylation or acetylation site and antibodies that specifically bind at a methylation or acetylation site. As used herein, an "antibody" or "antibodies" is meant to also encompass antibody binding fragments, including but not limited to, partial or full heavy chains or light chains, variable regions, or CDR regions of any methylation or acetylation site-specific antibodies described herein. In another embodiment, the antibody is a polyclonal antibody, a monoclonal antibody or antibody fragment, a recombinant antibody, a camelid antibody, a bispecific antibody, a diabody, a chimerized or chimeric antibody or antibody fragment, a humanized antibody or antibody fragment, a deimmunized human antibody or antibody fragment, a fully human antibody or antibody fragment, a single chain antibody, an Fv, an Fd, an Fab, an Fab', and an F(ab')$_2$. In certain embodiments, the compositions for detecting, quantitating or modulating a methylation or acetylation site of the disclosure are Heavy-Isotype Labeled Peptides (AQUA peptides) comprising a methylation or acetylation site.

In another aspect, the disclosure features methylation or acetylation site specific antibodies. In one embodiment, the antibodies specifically bind to an amino acid sequence comprising a methylation identified in Table 1 or acetylation site identified in Table 2 when the arginine or lysine identified in Column E is methylated, and do not significantly bind when the arginine or lysine is not methylated. In another embodiment, the antibodies specifically bind to an amino acid sequence comprising a methylation or acetylation site when the arginine or lysine is not methylated, and do not significantly bind when the lysine is methylated. In another embodiment, the antibodies are monoclonal or polyclonal antibodies.

In another aspect, the antibody inhibits tumor growth, inhibits cancer cell proliferation, inhibits cancer cell migration, inhibits metastasis of cancer cells, inhibits angiogenesis, or induces apoptosis. In one embodiment, the antibody is conjugated to a cytotoxic agent. In another embodiment, the cytotoxic agent is selected from the group consisting of a radiotherapeutic agent, a ribosome-inactivating protein (RIP), a chemotherapeutic agent, a cytotoxic small molecule, a cytotoxic peptide, and a cytotoxic protein.

In another aspect, the disclosure features a method for making methylation or acetylation site-specific antibodies.

In another aspect, the disclosure features compositions comprising a peptide, protein, or antibody of the disclosure, including pharmaceutical compositions.

In a further aspect, the disclosure features methods of treating or preventing cancer in a subject, wherein the cancer is associated with the methylation state of a methylation site in Table 1 or acetylation site in Table 2, whether methylated or not methylated. In certain embodiments, the methods comprise administering to a subject a therapeutically effective amount of a peptide comprising a methylation or acetylation site of the disclosure. In certain embodiments, the methods comprise administering to a subject a therapeutically effective amount of an antibody or antigen-binding fragment thereof that specifically binds at a methylation or acetylation site of the disclosure, whether methylated or not methylated, or acetylated or not acetylated, respectively. In another embodiment, the peptide or antibody reduces the at least one biological activity of a targeted signaling protein. In another embodiment, the biological activity of a targeted signaling is ligand binding or down-stream signal transduction. In another embodiment the antibody is conjugated to a cytotoxic agent (e.g., a radiotherapeutic agent, a ribosome-inactivating protein (RIP), a chemotherapeutic agent, a toxic small molecule, a toxic peptide, and a toxic protein).

In another aspect, the disclosure features methods of diagnosing carcinoma in a subject, wherein the carcinoma is associated with arginine or lysine methylation or acetylation or demethylation or deacetylation at a methylation site in Table 1 or acetylation site in Table 2. In one embodiment, the methylation or acetylation state or level at the arginine or lysine position identified in the corresponding row in Column E of Table 1 or Table 2 is determined to be present or not present in a biological sample. In another embodiment the methylation or acetylation state or level at the methylation or acetylation site, as compared to a control, is determined. In another embodiment the methylation or acetylation state or level is determined by an antibody that specifically binds to the methylation or acetylation site, when methylated or when not methylated. In a further embodiment an AQUA peptide, methylated at the arginine or lysine site, is used to identify and/or quantify.

In a further aspect, the disclosure features methods for detecting and quantitating methylation or acetylation at an arginine or lysine methylation or acetylation site of the disclosure.

In another aspect, the disclosure features a method for identifying an agent that modulates arginine or lysine methylation or acetylation at a methylation or acetylation site of the disclosure, comprising: contacting a peptide or protein comprising a methylation or acetylation site of the disclosure with a candidate agent, and determining the methylation or acetylation state or level at the methylation or acetylation site. A change in the methylation or acetylation state or level at the specified arginine or lysine in the presence of the test agent, as compared to a control, indicates that the candidate agent potentially modulates arginine or lysine methylation or actylation at a methylation or acetylation site disclosed.

In another aspect, immunoassays for binding, purifying, quantifying and otherwise generally detecting the methylation or acetylation of a protein or peptide at a methylation or acetylation site are disclosed.

Another embodiment provides a method comprising: (a) obtaining a digested proteinaceous preparation comprising a digested biological sample; (b) contacting the proteinaceous preparation with an immobilized antibody or antibody fragment that binds to a recurring protein motif or to a post-translational modification in a context-independent manner; and (c) isolating a population of peptides specifically bound by the immobilized antibody or antibody fragment; wherein the biological sample is not immunodepleted of one or more proteins selected from the group consisting of: alpha 1-acid glycoprotein, alpha 1-antitrypsin, alpha 2-macroglobulin, albumin, apolipoprotein A1, apolipoprotein A2, apolipoprotein B, fibrinogen, haptoglobin, IgA, IgD, IgG, IgM, transferrin, complement C3, complement C4, complement C1q, ceruloplasmin, prealbumin, and plasminogen. In on aspect, the biological sample is not immunodepleted of any combination of one or more proteins selected from the group consisting of: alpha 1-acid glycoprotein, alpha 1-antitrypsin, alpha 2-macroglobulin, albumin, apolipoprotein A1, apolipoprotein A2, apolipoprotein B, fibrinogen, haptoglobin, IgA, IgD, IgG, IgM, transferrin, complement C3, complement C4, complement C1q, ceruloplasmin, prealbumin, and plasminogen.

In one aspect said biological sample is digested utilizing a reagent selected from the group consisting of cyanogen bromide, BNPS-Skatole, formic acid, trypsin, Lysine-C endopeptidase (LysC); arginine-C endopeptidase (ArgC), Asp-N, glutamic acid, endopeptidase (GluC), chymotrypsin, and combinations thereof. In one aspect the reagent is trypsin. In another aspect, the biological sample is derived from saliva, mucous, tears, blood, serum, lymph fluids, buccal cells, circulating tumor cells, mucosal cells, biopsy tissue, cerebrospinal fluid, semen, feces, plasma, urine, a suspension of cells, or a suspension of cells and viruses. Another aspect provides that the biological sample is derived from serum or plasma.

In another aspect, the antibody or antibody fragment is selected from the group consisting of a polyclonal antibody, a monoclonal antibody or antibody fragment, a recombinant antibody, a camelid antibody, a bispecific antibody, a diabody, a chimerized or chimeric antibody or antibody fragment, a humanized antibody or antibody fragment, a deimmunized human antibody or antibody fragment, a fully human antibody or antibody fragment, a single chain antibody, an Fv, an Fd, an Fab, an Fab', and an $F(ab')_2$. In another aspect the antibody is a polyclonal antibody. In another aspect, the antibody is a monoclonal antibody.

Also featured are pharmaceutical compositions and kits comprising one or more antibodies or peptides of the disclosure and methods of using them.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Reference is made herein to various methodologies and materials known to those of skill in the art. Standard reference works setting forth the general principles of recombinant DNA technology include Sambrook et al., Molecular Cloning: A Laboratory Manual, 2nd Ed., Cold Spring Harbor Laboratory Press, New York (1989); Kaufman et al., Eds., Handbook of Molecular and Cellular Methods in Biology in Medicine, CRC Press, Boca Raton (1995); McPherson, Ed., Directed Mutagenesis: A Practical Approach, IRL Press, Oxford (1991). Standard reference works setting forth the general principles of antibody technology include Greenfield, Ed., Antibodies: A Laboratory Manual, 2d Ed., Cold Spring Harbor Laboratory Press, New York (2014); Coligan et al., Eds., Current Protocols in Immunology, DOI: 10.1002/0471142735 (February 2014); and Lo, Ed., Antibody Engineering: Methods and Protocols, Humana Press, Totawa, N.J. (2004). Standard reference works setting forth the general principles of pharmacology include Goodman and Gilman's The Pharmacological Basis of Therapeutics, 11th Ed., McGraw Hill Companies Inc., New York (2006). The above reference works are incorporated by reference herein in their entireties.

As used herein, the following terms have the meanings indicated. As used in this specification, the singular forms "a," "an" and "the" specifically also encompass the plural forms of the terms to which they refer, unless the content clearly dictates otherwise. The term "about" is used herein to mean approximately, in the region of, roughly, or around. When the term "about" is used in conjunction with a numerical range, it modifies that range by extending the boundaries above and below the numerical values set forth.

In general, the term "about" is used herein to modify a numerical value above and below the stated value by a variance of 20%. Where combinations of alternatives are provided (e.g., combinations of alternative CDR sequences or combinations of alternative light and/or heavy chain sequences), the description includes each combination taken individually, as well as combinations of subsets of the alternatives.

Other features and advantages of the invention will be apparent from the following detailed description, and from the claims.

DETAILED DESCRIPTION

Disclosed are arginine and lysine methylation or acetylation sites in signaling proteins extracted from mouse brain, mouse embryo, human serum, and HTC116 cell line. The newly discovered methylation and acetylation sites significantly extend our knowledge of methyltranferase substrates and of the proteins in which the sites occur. The disclosure of the methylation or acetylation sites and reagents including peptides and antibodies specific for the sites add important new tools for the elucidation of signaling pathways that are associate with a host of biological processes including cell division, growth, differentiation, develomental changes and disease. Their discovery provides and focuses further elucidation of the role and function of protein methylation and acetylation in cell biology. Additionally, the sites provide additional diagnostic and therapeutic targets.

Methylation and Acetylation Sites

In one aspect, the disclosure features arginine and lysine methylation or acetylation sites in signaling proteins from cellular extracts from mouse brain and mouse embryo samples, human serum, and from the human HCT 116 cell line (see further description below in Examples), identified using the techniques described in Rush et al., "Immunoaffinity Isolation of Modified Peptides From Complex Mixtures," U.S. Pat. Nos. 7,198,896 and 7,300,753. Table 1 summarizes the identified methylation and Table 2 summerizes the identified acetylation sites.

These methylation or acetylation sites thus occur in proteins found in various diseases. The sequences of the human homologues are publicly available in SwissProt database and their Accession numbers listed in Column C of Table 1 and Table 2. The sites occur in proteins such as: secreted proteins, adaptor/scaffold proteins, non-receptor ser/thr protein kinases, non-receptor tyrosine protein kinases, chromatin/DNA binding/repair/replication proteins, cytoskeletal proteins, mitochondrial proteins, transcriptional regulators, translational regulators, ubiquitin conjugating system, cell cycle regulation proteins, RNA processing proteins, adhesion or extracellular matrix proteins, proteases, kinases, apoptosis proteins, chaperone proteins, receptor/channel/transporter/cell surface proteins, enzymes, G proteins or regulator proteins, Endoplasmic reticulum or golgi proteins, calcium-binding proteins, vesicle proteins, motor or contractile proteins, non-protein kinases, phosphatases, and proteins of unknown function (see Column E of Table 1 or Table 2).

The methylation or acetylation sites of the disclosure were identified according to the methods described by Rush et al., "Immunoaffinity Isolation of Modified Peptides From Complex Mixtures," U.S. Pat. Nos. 7,198,896 and 7,300,753, and which are herein incorporated by reference in its entirety. The sites of the disclosure were discovered using a modification of the method described in Gygi et al., U.S. Patent Publication No. 20060148093 (herein incorporated by reference in its entirety) which describes a method for detecting and quantifying proteins (and post-translational protein modifications such as methylation) by mass spectrophotometry analysis using peptide internal standards.

Briefly, the methylation or acetylation sites of the disclosure were isolated and characterized by immunoaffinity isolation and mass-spectrometric characterization (IAP), using various cell lines and tissues from mice and humans (see Column F of Table 1 or Table 2). In addition to the newly discovered methylation or acetylation sites (all having a methylatable arginine or lysine or an acetylatable lysine), many known methylation or acetylation sites were also identified. The immunoaffinity/mass spectrometric technique described in Rush et al, i.e., the "IAP" method, is described in detail in the Examples and briefly summarized below.

The IAP method generally comprises the following steps: (a) a proteinaceous preparation (e.g., a digested cell extract) comprising methylated peptides from two or more different proteins is obtained from an organism; (b) the preparation is contacted with at least one immobilized general methylated residue (e.g., methyl-lysine or methyl-arginine)-specific antibody; (c) at least one methylated peptide specifically bound by the immobilized antibody in step (b) is isolated; and (d) the modified peptide isolated in step (c) is characterized by mass spectrometry (MS) and/or tandem mass spectrometry (MS-MS). Subsequently, (e) a search program (e.g., Sequest) may be utilized to substantially match the spectra obtained for the isolated, modified peptide during the characterization of step (d) with the spectra for a known peptide sequence. A quantification step, e.g., using SILAC or AQUA, may also be used to quantify isolated peptides in order to compare peptide levels in a sample to a reference or baseline.

In the IAP method as disclosed herein, a general methylated lysine-specific or arginine-specific monoclonal antibody may be used in the immunoaffinity step to isolate the widest possible number of methylated-lysine or methylated-arginine containing peptides from the cell extracts.

As described in more detail in the Examples, lysates may be prepared from various cell lines or tissue samples and digested with a protease (e.g., trypsin) after treatment with DTT and iodoacetamide to alkylate cysteine residues. Before the immunoaffinity step, peptides may be pre-fractionated (e.g., by reversed-phase solid phase extraction using Sep-Pak $C_{18}$ columns) to separate peptides from other cellular components. The solid phase extraction cartridges may then be eluted (e.g., with acetonitrile). Each lyophilized peptide fraction can be redissolved and treated with a methyl-lysine or methyl-arginine specific antibody immobilized on protein Agarose. Immunoaffinity-purified peptides can be eluted and a portion of this fraction may be concentrated (e.g., with Stage or Zip tips) and analyzed by LC-MS/MS (e.g., using a ThermoFinnigan LCQ Deca XP Plus ion trap mass spectrometer or LTQ). MS/MS spectra can be evaluated using, e.g., the program Sequest with the NCBI human protein database.

The methylation sites identified are summarized in Table 1 (SEQ ID NOs: 1-4977) and the acetylation sites identified are summarized in Table 2 (SEQ ID NOs: 4978-5487). For each row, Column B lists the parent (signaling) protein in which the methylation or acetylation site occurs; Column C lists the SwissProt accession number for the human homologue of the identified parent proteins; Column D lists the protein type/classification of the parent protein; Column E identifies the arginine or lysine residue at which methylation occurs (each number refers to the amino acid residue position of the arginine or lysine in the parent human protein, according to the published sequence retrieved by the SwissProt accession number); Column F shows flanking sequences of the identified methylatable arginine or lysine residues (which are the sequences of trypsin-digested peptides). (Note that the SEQ ID NO for the trypsin-digested peptide sequence set forth in Column F is given in Column H); Column G lists the cell line/Tissue type in which methylation or acetylation site was discovered.

One of skill in the art will appreciate that, in many instances the utility of the instant disclosure is best understood in conjunction with an appreciation of the many biological roles and significance of the various target signaling proteins/polypeptides of the disclosure.

The disclosure also features peptides comprising a methylation or acetylation site of the disclosure. In one particular embodiment, the peptides comprise any one of the an amino acid sequences as set forth in column F of Table 1 or Table 2, which are trypsin-digested peptide fragments of the parent proteins. Alternatively, a parent signaling protein listed in Table 1 or Table 2 may be digested with another protease, and the sequence of a peptide fragment comprising a methylation or acetylation site can be obtained in a similar way. Suitable proteases include, but are not limited to, serine proteases (e.g. hepsin), metallo proteases (e.g. PUMP1), chymotrypsin, cathepsin, pepsin, thermolysin, carboxypeptidases, etc.

The disclosure also features proteins and peptides that are mutated to eliminate a methylation or acetylation site of the disclosure. Such proteins and peptides are particular useful as research tools to understand complex signaling transduction pathways of cancer cells, for example, to identify new upstream methylase(s) or demethylase(s) or other proteins that regulates the activity of a signaling protein; to identify downstream effector molecules that interact with a signaling protein, etc.

Various methods that are well known in the art can be used to eliminate a methylation or acetylation site. For example, the methylatable arginine or lysine or acetylatable lysine may be mutated into a non-methylatable or—acetylatable residue, such as glutamine. A "methylatable" amino acid refers to an amino acid that is capable of being modified by addition of a methyl group (and includes both methylated form and unmethylated form). An "acetylatable" amino acid refers to an amino acid that is capable of being modified by addition of a acetyl group (and includes both acetylated form and unacetylated form). Alternatively, the arginine or lysine may be deleted. Residues other than the arginine or lysine may also be modified (e.g., delete or mutated) if such modification inhibits the methylation of the arginine or lysine residue. For example, residues flanking the arginine or lysine may be deleted or mutated, so that a methylase cannot recognize/methylated the mutated protein or the peptide. Standard mutagenesis and molecular cloning techniques can be used to create amino acid substitutions or deletions.

Modulators of the Methylation or Acetylation Sites

In another aspect, the disclosure features a modulator that modulates arginine or lysine methylation at a methylation or acetylation site of the disclosure, including small molecules, peptides comprising a methylation or acetylation site, and binding molecules that specifically bind at a methylation or acetylation site, including but not limited to antibodies or antigen-binding fragments thereof.

Modulators of an methylation or acetylation site include any molecules that directly or indirectly counteract, reduce, antagonize or inhibit arginine or lysine methylation or acetylation of the site. The modulators may compete or block the binding of the to its upstream methylase(s) or demethylase(s), or to its downstream signaling transduction molecule(s).

The modulators may directly interact with a methylation or acetylation site. The modulator may also be a molecule that does not directly interact with a methylation or acetylation site. For example, the modulators can be dominant negative mutants, i.e., proteins and peptides that are mutated to eliminate the methylation or acetylation site. Such mutated proteins or peptides could retain the binding ability to a downstream signaling molecule but lose the ability to trigger downstream signaling transduction of the wild type parent signaling protein.

The modulators include small molecules that modulate the arginine or lysine methylation or acetylation at a methylation or acetylation site of the disclosure. Chemical agents, referred to in the art as "small molecule" compounds are typically organic, non-peptide molecules, having a molecular weight less than 10,000, less than 5,000, less than 1,000, or less than 500 daltons. This class of modulators includes chemically synthesized molecules, for instance, compounds from combinatorial chemical libraries. Synthetic compounds may be rationally designed or identified based on known or inferred properties of a methylation or acetylation site of the disclosure or may be identified by screening compound libraries. Alternative appropriate modulators of this class are natural products, particularly secondary metabolites from organisms such as plants or fungi, which can also be identified by screening compound libraries. Methods for generating and obtaining compounds are well known in the art (Schreiber S L, Science 151: 1964-1969 (2000); Radmann J. and Gunther J., Science 151: 1947-1948 (2000)).

The modulators also include peptidomimetics, small protein-like chains designed to mimic peptides. Peptidomimetics may be analogues of a peptide comprising a methylation or acetylation site of the disclosure. Peptidomimetics may also be analogues of a modified peptide that are mutated to eliminate a methylation or acetylation site of the disclosure. Peptidomimetics (both peptide and non-peptidyl analogues) may have improved properties (e.g., decreased proteolysis, increased retention or increased bioavailability). Peptidomimetics generally have improved oral availability, which makes them especially suited to treatment of disorders in a human or animal.

In certain embodiments, the modulators are peptides comprising a methylation or acetylation site of the disclosure. In certain embodiments, the modulators are antibodies or antigen-binding fragments thereof that specifically bind at a methylation or acetylation site of the disclosure.

Heavy-Isotope Labeled Peptides (AQUA Peptides).

In another aspect, the invention provides peptides comprising a methylation or acetylation site of the invention. In a particular embodiment, the invention provides Heavy-Isotope Labeled Peptides (AQUA peptides) comprising a methylation or acetylation site. Such peptides are useful to generate methylation or acetylation site-specific antibodies for a methylation or acetylation site. Such peptides are also useful as potential diagnostic tools for screening different types of diseases including cancer (e.g., a carcinoma such as colorectal cancer), or as potential therapeutic agents for treating diseases such as carcinomas (e.g., colorectal cancer).

The peptides may be of any length, typically six to fifteen amino acids. The methylation or acetylation site can occur at any position in the peptide; if the peptide will be used as an immunogen, it typically is from seven to twenty amino acids in length. In some embodiments, the peptide is labeled with a detectable marker.

"Heavy-isotope labeled peptide" (used interchangeably with AQUA peptide) refers to a peptide comprising at least one heavy-isotope label, as described in PCT Publication No. WO/03016861, "Absolute Quantification of Proteins and Modified Forms Thereof by Multistage Mass Spectrometry" (Gygi et al.) (the teachings of which are hereby incorporated herein by reference, in their entirety). The amino acid sequence of an AQUA peptide is identical to the sequence of a proteolytic fragment of the parent protein in which the methylation or acetylation site occurs. AQUA peptides of the invention are highly useful for detecting, quantitating or modulating a methylation or acetylation site of the invention (both in methylated and non-methylated forms) in a biological sample.

A peptide of the invention, including an AQUA peptide, comprises any methylation or acetylation site. In some embodiments, the peptide or AQUA peptide comprises a methylation site of a protein in Table 1 or acetylation site of a protein in Table 2 that may be a secreted protein, adaptor/scaffold protein, non-receptor ser/thr protein kinase, non-receptor tyrosine protein kinase, chromatin/DNA binding/repair/replication protein, cytoskeletal protein, mitochondrial protein, transcriptional regulator, translational regulator, ubiquitin conjugating system protein, cell cycle regulation protein, RNA processing protein, adhesion or extracellular matrix protein, proteases, kinases (or regulatory subunit thereof), apoptosis protein, chaperone protein, receptor/channel/transporter/cell surface protein, enzyme, G protein or regulator protein, endoplasmic reticulum or golgi protein, calcium-binding protein, vesicle proteins, motor or contractile protein, non-protein kinase, phosphatase, or a protein of unknown function.

In some embodiments, the peptide or AQUA peptide comprises the amino acid sequence shown in any one of the above listed SEQ ID NOs. In some embodiments, the peptide or AQUA peptide consists of the amino acid sequence in said SEQ ID NOs. In some embodiments, the peptide or AQUA peptide comprises a fragment of the amino acid sequence in said SEQ ID NOs., wherein the fragment is six to twenty amino acids long and includes the methylatable lysine or arginine. In some embodiments, the peptide or AQUA peptide consists of a fragment of the amino acid sequence in said SEQ ID NOs., wherein the fragment is six to twenty amino acids long and includes the methylatable lysine or arginine.

In certain embodiments, the peptide or AQUA peptide comprises any one of the SEQ ID NOs listed in column H, which are trypsin-digested peptide fragments of the parent proteins.

It is understood that parent protein listed in Table 1 or Table 2 may be digested with any suitable protease (e.g., serine proteases (e.g. trypsin, hepsin), metallo proteases (e.g. PUMP1), chymotrypsin, cathepsin, pepsin, thermolysin, carboxypeptidases, etc.), and the resulting peptide sequence comprising a methylatable site of the invention may differ from that of trypsin-digested fragments (as set forth in Column F), depending the cleavage site of a particular enzyme. An AQUA peptide for a particular a parent protein sequence should be chosen based on the amino acid sequence of the parent protein and the particular protease for digestion; that is, the AQUA peptide should match the amino acid sequence of a proteolytic fragment of the parent protein in which the methylation or acetylation site occurs.

An AQUA peptide is typically at least about 6 amino acids long. An exemplary range is about 7 to 15 amino acids in length. A peptide sequence can be selected that is not likely to be chemically reactive during mass spectrometry. For example, sequences comprising cysteine, tryptophan, or methionine can be avoided.

The AQUA method detects and quantifies a target protein in a sample by introducing a known quantity of at least one heavy-isotope labeled peptide standard (which has a unique signature detectable by LC-SRM chromatography) into a digested biological sample. By comparing to the peptide standard, one may readily determine the quantity of a peptide having the same sequence and protein modification(s) in the biological sample. Briefly, the AQUA methodology has two stages: (1) peptide internal standard selection and validation; method development; and (2) implementation using validated peptide internal standards to detect and quantify a target protein in a sample. The method is a powerful technique for detecting and quantifying a given peptide/protein within a complex biological mixture, such as a cell lysate, and may be used, e.g., to quantify change in protein methylation as a result of drug treatment, or to quantify a protein in different biological states.

Generally, to develop a suitable internal standard, a particular peptide (or modified peptide) within a target protein sequence is chosen based on its amino acid sequence and a particular protease for digestion. The peptide is then generated by solid-phase peptide synthesis such that one residue is replaced with that same residue containing stable isotopes ($^{13}C$, $^{15}N$). The result is a peptide that is chemically identical to its native counterpart formed by proteolysis, but is easily distinguishable by MS via a mass shift. A newly synthesized AQUA internal standard peptide is then evaluated by LC-MS/MS. This process provides qualitative information about peptide retention by reverse-phase chromatography, ionization efficiency, and fragmentation via collision-induced dissociation. Informative and abundant fragment ions for sets of native and internal standard peptides are chosen and then specifically monitored in rapid succession as a function of chromatographic retention to form a selected reaction monitoring (LC-SRM) method based on the unique profile of the peptide standard.

The second stage of the AQUA strategy is its implementation to measure the amount of a protein or the modified form of the protein from complex mixtures. Whole cell lysates are typically fractionated by SDS-PAGE gel electrophoresis, and regions of the gel consistent with protein migration are excised. This process is followed by in-gel proteolysis in the presence of the AQUA peptides and LC-SRM analysis. (See Gerber et al. supra.) AQUA peptides are spiked in to the complex peptide mixture obtained by digestion of the whole cell lysate with a proteolytic enzyme and subjected to immunoaffinity purification as described above. The retention time and fragmentation pattern of the native peptide formed by protease digestion (e.g., trypsinization) is identical to that of the AQUA internal standard peptide determined previously; thus, LC-MS/MS analysis using an SRM experiment results in the highly specific and sensitive measurement of both internal standard and analyte directly from extremely complex peptide mixtures. Because an absolute amount of the AQUA peptide is added (e.g. 250 fmol), the ratio of the areas under the curve can be used to determine the precise expression levels of a protein or methylated form of a protein in the original cell lysate. In addition, the internal standard is present during in-gel digestion as native peptides are formed, such that peptide extraction efficiency from gel pieces, absolute losses during sample handling (including vacuum centrifugation), and variability during introduction into the LC-MS system do not affect the determined ratio of native and AQUA peptide abundances.

An AQUA peptide standard may be developed for a known methylation site previously identified by the IAP-LC-MS/MS method within a target protein. One AQUA peptide incorporating the methylated form of the site, and a second AQUA peptide incorporating the non-methylated form of site may be developed. In this way, the two standards may be used to detect and quantify both the methylated and non-methylated forms of the site in a biological sample.

Peptide internal standards may also be generated by examining the primary amino acid sequence of a protein and determining the boundaries of peptides produced by protease cleavage. Alternatively, a protein may actually be digested with a protease and a particular peptide fragment produced can then sequenced. Suitable proteases include, but are not limited to, serine proteases (e.g. trypsin, hepsin), metallo proteases (e.g. PUMP1), chymotrypsin, cathepsin, pepsin, thermolysin, carboxypeptidases, etc.

A peptide sequence that is outside a methylation or acetylation site may be selected as internal standard to determine the quantity of all forms of the target protein. Alternatively, a peptide encompassing a methylated site may be selected as internal standard to detect and quantify only the methylated form of the target protein. Peptide standards for both methylated form and non-methylated form can be used together, to determine the extent of methylation in a particular sample.

The peptide is labeled using one or more labeled amino acids (i.e. the label is an actual part of the peptide) or labels may be attached after synthesis according to standard methods. In some embodiments, the label is a mass-altering label selected based on the following considerations: The mass should be unique to shift fragment masses produced by MS analysis to regions of the spectrum with low background; the ion mass signature component is the portion of the labeling moiety that exhibits a unique ion mass signature in MS analysis; the sum of the masses of the constituent atoms of the label can be uniquely different than the fragments of all the possible amino acids. As a result, the labeled amino acids and peptides are readily distinguished from unlabeled ones by the ion/mass pattern in the resulting mass spectrum. The ion mass signature component can be selected to impart a mass to a protein fragment that does not match the residue mass for any of the 20 natural amino acids.

The label should be robust under the fragmentation conditions of MS and not undergo unfavorable fragmentation. Labeling chemistry can be selected be efficient under a range of conditions, particularly denaturing conditions, and the labeled tag can be selected such that it remains soluble in the MS buffer system of choice. In some embodiments, the label does not suppress the ionization efficiency of the protein and is not chemically reactive. The label may contain a mixture of two or more isotopically distinct species to generate a unique mass spectrometric pattern at each labeled fragment position. Stable isotopes, such as $^{13}C$, $^{15}N$, $^{17}O$, $^{18}O$, or $^{34}S$, are among the exemplary labels that may be used. Pairs of peptide internal standards that incorporate a different isotope label may also be prepared. Exemplary amino acid residues into which a heavy isotope label may be incorporated include leucine, proline, valine, and phenylalanine.

Peptide internal standards can be characterized according to their mass-to-charge (m/z) ratio, and also according to their retention time on a chromatographic column (e.g. an HPLC column). Internal standards that co-elute with unlabeled peptides of identical sequence are selected as optimal internal standards. The internal standard is then analyzed by fragmenting the peptide by any suitable means, for example by collision-induced dissociation (CID) using, e.g., argon or helium as a collision gas. The fragments are then analyzed, for example by multi-stage mass spectrometry (MS") to obtain a fragment ion spectrum, to obtain a peptide fragmentation signature. Peptide fragments can be selected that have significant differences in m/z ratios to enable peaks corresponding to each fragment to be well separated, and a signature that is unique for the target peptide is obtained. If a suitable fragment signature is not obtained at the first stage, additional stages of MS are performed until a unique signature is obtained.

Fragment ions in the MS/MS and $MS^3$ spectra are typically highly specific for the peptide of interest, and, in conjunction with LC methods, allow a highly selective means of detecting and quantifying a target peptide/protein in a complex protein mixture, such as a cell lysate, containing many thousands or tens of thousands of proteins. Any biological sample potentially containing a target protein/peptide of interest may be assayed. Crude or partially purified cell extracts can be used. Generally, the sample has at least 0.01 mg of protein, typically a concentration of 0.1-10 mg/mL, and may be adjusted to a desired buffer concentration and pH.

A known amount of a labeled peptide internal standard, e.g., about 10 femtomoles, corresponding to a target protein to be detected/quantified is then added to a biological sample, such as a cell lysate. The spiked sample is then digested with one or more protease(s) for a suitable time period to allow digestion. A separation is then performed (e.g., by HPLC, reverse-phase HPLC, capillary electrophoresis, ion exchange chromatography, etc.) to isolate the labeled internal standard and its corresponding target peptide from other peptides in the sample. Microcapillary LC is an exemplary method.

Each isolated peptide is then examined by monitoring of a selected reaction in the MS. This involves using the prior knowledge gained by the characterization of the peptide internal standard and then requiring the MS to continuously monitor a specific ion in the MS/MS or MS" spectrum for both the peptide of interest and the internal standard. After elution, the area under the curve (AUC) for both peptide standard and target peptide peaks are calculated. The ratio of the two areas provides the absolute quantification that can be normalized for the number of cells used in the analysis and the protein's molecular weight, to provide the precise number of copies of the protein per cell. Further details of the AQUA methodology are described in Gygi et al., PCT Publication No. WO/03016861, and Gerber et al., *Proc. Natl. Acad. Sci. U.S.A.* 100: 6940-5 (2003), both of which are hereby incorporated by reference in their entirety.

Accordingly, AQUA internal peptide standards (heavy-isotope labeled peptides) may be produced, as described above, for any of the methylation sites of the invention (see Table 1) or acetylation sites of the invention (see Table 2). For example, peptide standards for a given methylation or acetylation site may be produced for both the methylated and non-methylated forms of the sequence. Such standards may be used to detect and quantify both methylated form and non-methylated form of the parent protein in a biological sample.

Heavy-isotope labeled equivalents of a methylation or acetylation site of the disclosure, both in methylated and non-methylated form, can be readily synthesized and their unique MS and LC-SRM signature determined, so that the peptides are validated as AQUA peptides and ready for use in quantification.

The methylation or acetylation sites of the invention are particularly well suited for development of corresponding AQUA peptides, since the IAP method by which they were identified inherently confirmed that such peptides are in fact produced by enzymatic digestion (e.g., trypsinization) and are in fact suitably fractionated/ionized in MS/MS. Thus, heavy-isotope labeled equivalents of these peptides (both in methylated and non-methylated form) can be readily synthesized and their unique MS and LC-SRM signature determined, so that the peptides are validated as AQUA peptides and ready for use in quantification experiments.

Peptides and AQUA peptides provided by the invention will be highly useful in the further study of signal transduction anomalies underlying cancer, including carcinomas. Peptides and AQUA peptides of the invention may also be used for identifying diagnostic/bio-markers of carcinomas, identifying new potential drug targets, and/or monitoring the effects of test therapeutic agents on signaling proteins and pathways.

Methylation or Acetylation Site-Specific Antibodies

In another aspect, the disclosure discloses methylation or acetylation site-specific binding molecules that specifically bind at a arginine or lysine methylation or acetylation site of the disclosure, and that distinguish between the methylated and unmethylated forms. In one embodiment, the binding molecule is an antibody or an antigen-binding fragment thereof. The antibody may specifically bind to an amino acid sequence comprising a methylation site identified in Table 1 or acetylation site identified in Table 2.

In some embodiments, the antibody or antigen-binding fragment thereof specifically binds the methylated or acetylated site. In other embodiments, the antibody or antigen-binding fragment thereof specially binds the unmethylated or unacetylated site. An antibody or antigen-binding fragment thereof specially binds an amino acid sequence comprising an arginine or lysine methylation site in Table 1 or a lysine acetylation site in Table 2 when it does not significantly bind any other site in the parent protein and does not significantly bind a protein other than the parent protein. An antibody of the disclosure is sometimes referred to herein as a "methyl-specific" or "acetyl-specific" antibody, e.g., a methyl-arginine specific antibody or a methyl-lysine specific antibody.

An antibody or antigen-binding fragment thereof specially binds an antigen when the dissociation constant is ≤1 mM, e.g., ≤100 nM or ≤10 nM.

In some embodiments, the antibody or antigen-binding fragment of the disclosure binds an amino acid sequence that comprises a methylation site of a protein in Table 1 or acetylation site of a protein in Table 2 that is a secreted protein, adaptor/scaffold protein, non-receptor ser/thr protein kinase, non-receptor tyrosine protein kinase, chromatin/DNA binding/repair/replication protein, cytoskeletal protein, mitochondrial protein, transcriptional regulator, translational regulator, cell cycle regulation protein, RNA processing protein, adhesion or extracellular matrix protein, proteases, kinases (or regulatory subunit thereof), apoptosis protein, chaperone protein, receptor/channel/transporter/cell surface protein, enzyme, G protein or regulator protein, endoplasmic reticulum or golgi protein, calcium-binding protein, vesicle proteins, motor or contractile protein, non-protein kinase, phosphatase, or a protein of unknown function.

In some embodiments, an antibody or antigen-binding fragment thereof of the disclosure specifically binds an amino acid sequence comprising any one of the above listed SEQ ID NOs. In some embodiments, an antibody or antigen-binding fragment thereof of the disclosure especially binds an amino acid sequence comprises a fragment of one of said SEQ ID NOs., wherein the fragment is four to twenty amino acid long and includes the methylatable arginine or lysine.

In certain embodiments, an antibody or antigen-binding fragment thereof of the disclosure specially binds an amino acid sequence that comprises a peptide produced by proteolysis of the parent protein with a protease wherein said peptide comprises a arginine or lysine methylation or acetylation site of the disclosure. In some embodiments, the peptides are produced from trypsin digestion of the parent protein. The parent protein comprising the arginine or lysine methylation or acetylation site can be from any species, e.g., from a mammal including but not limited to non-human primates, rabbits, mice, rats, goats, cows, sheep, and guinea pigs. In some embodiments, the parent protein is a human protein and the antibody binds an epitope comprising the arginine or lysine methylation shown by a lower case "k" or "r" Column F of Table 1 or acetylation site shown by a lower case "k" in Column F of Table 2. Such peptides include any one of the SEQ ID NOs.

An antibody of the disclosure can be an intact, four immunoglobulin chain antibody comprising two heavy chains and two light chains. The heavy chain of the antibody can be of any isotype including IgM, IgG, IgE, IgG, IgA or IgD or sub-isotype including IgG1, IgG2, IgG3, IgG4, IgE1, IgE2, etc. The light chain can be a kappa light chain or a lambda light chain.

Also within the disclosure are antibody molecules with fewer than 4 chains, including single chain antibodies, Camelid antibodies and the like and components of the antibody, including a heavy chain or a light chain. The term "antibody" (or "antibodies") refers to all types of immunoglobulins. The term "an antigen-binding fragment of an antibody" refers to any portion of an antibody that retains specific binding of the intact antibody. An exemplary antigen-binding fragment of an antibody is the heavy chain and/or light chain CDR, or the heavy and/or light chain variable region. The term "does not bind," when appeared in context of an antibody's binding to one methyl-form (e.g., methylated form) of a sequence, means that the antibody does not substantially react with the other methyl-form (e.g., non-methylated form) of the same sequence. One of skill in the art will appreciate that the expression may be applicable in those instances when (1) an methyl-specific antibody either does not apparently bind to the non-methyl form of the antigen as ascertained in commonly used experimental detection systems (Western blotting, IHC, Immunofluorescence, etc.); (2) where there is some reactivity with the surrounding amino acid sequence, but that the methylated residue is an immunodominant feature of the reaction. In cases such as these, there is an apparent difference in affinities for the two sequences. Dilutional analyses of such antibodies indicates that the antibodies apparent affinity for the methylated form is at least 10-100 fold higher than for the non-methylated form; or where (3) the methyl-specific antibody reacts no more than an appropriate control antibody would react under identical experimental conditions. A control antibody preparation might be, for instance, purified immunoglobulin from a pre-immune animal of the same species, an isotype- and species-matched monoclonal antibody. Tests using control antibodies to demonstrate specificity are recognized by one of skill in the art as appropriate and definitive.

In some embodiments an immunoglobulin chain may comprise in order from 5' to 3', a variable region and a constant region. The variable region may comprise three complementarity determining regions (CDRs), with interspersed framework (FR) regions for a structure FR1, CDR1, FR2, CDR2, FR3, CDR3 and FR4. Also within the disclosure are heavy or light chain variable regions, framework regions and CDRs. An antibody of the disclosure may comprise a heavy chain constant region that comprises some or all of a CH1 region, hinge, CH2 and CH3 region.

An antibody of the disclosure may have an binding affinity ($K_D$) of $1\times10^{-7}$ M or less. In other embodiments, the antibody binds with a $K_D$ of $1\times10^{-8}$ M, $1\times10^{-9}$ M, $1\times10^{-10}$ M, $1\times10^{-11}$ M, $1\times10^{-12}$ M or less. In certain embodiments, the $K_D$ is 1 pM to 500 pM, between 500 pM to 1 μM, between 1 μM to 100 nM, or between 100 mM to 10 nM.

Antibodies of the disclosure can be derived from any species of animal, e.g., a mammal. Non-limiting exemplary natural antibodies include antibodies derived from human, chicken, goats, and rodents (e.g., rats, mice, hamsters and rabbits), including transgenic rodents genetically engineered to produce human antibodies (see, e.g., Lonberg et al., WO93/12227; U.S. Pat. No. 5,545,806; and Kucherlapati, et al., WO91/10741; U.S. Pat. No. 6,150,584, which are herein incorporated by reference in their entirety). Natural antibodies are the antibodies produced by a host animal. "Genetically altered antibodies" refer to antibodies wherein the amino acid sequence has been varied from that of a native antibody. Because of the relevance of recombinant DNA techniques to this application, one need not be confined to the sequences of amino acids found in natural antibodies; antibodies can be redesigned to obtain desired characteristics. The possible variations are many and range from the changing of just one or a few amino acids to the complete redesign of, for example, the variable or constant region. Changes in the constant region will, in general, be made in order to improve or alter characteristics, such as complement fixation, interaction with membranes and other effector functions. Changes in the variable region will be made in order to improve the antigen binding characteristics.

The antibodies of the disclosure include antibodies of any isotype including IgM, IgG, IgD, IgA and IgE, and any sub-isotype, including IgG1, IgG2a, IgG2b, IgG3 and IgG4, IgE1, IgE2 etc. The light chains of the antibodies can either be kappa light chains or lambda light chains.

Antibodies disclosed in the disclosure may be polyclonal or monoclonal. As used herein, the term "epitope" refers to the smallest portion of a protein capable of selectively binding to the antigen binding site of an antibody. It is well accepted by those skilled in the art that the minimal size of a protein epitope capable of selectively binding to the antigen binding site of an antibody is about five or six to seven amino acids.

Other antibodies specifically contemplated are oligoclonal antibodies. As used herein, the phrase "oligoclonal antibodies" refers to a predetermined mixture of distinct monoclonal antibodies. See, e.g., PCT publication WO 95/20401; U.S. Pat. Nos. 5,789,208 and 6,335,163. In one embodiment, oligoclonal antibodies consisting of a predetermined mixture of antibodies against one or more epitopes are generated in a single cell. In other embodiments, oligoclonal antibodies comprise a plurality of heavy chains capable of pairing with a common light chain to generate antibodies with multiple specificities (e.g., PCT publication WO 04/009618). Oligoclonal antibodies are particularly useful when it is desired to target multiple epitopes on a single target molecule. In view of the assays and epitopes disclosed herein, those skilled in the art can generate or select antibodies or mixtures of antibodies that are applicable for an intended purpose and desired need.

Recombinant antibodies against the methylation or acetylation sites identified in the disclosure are also included in the present application. These recombinant antibodies have the same amino acid sequence as the natural antibodies or have altered amino acid sequences of the natural antibodies in the present application. They can be made in any expression systems including both prokaryotic and eukaryotic expression systems or using phage display methods (see, e.g., Dower et al., WO91/17271 and McCafferty et al., WO92/01047; U.S. Pat. No. 5,969,108, which are herein incorporated by reference in their entirety).

Antibodies can be engineered in numerous ways. They can be made as single-chain antibodies (including small modular immunopharmaceuticals or SMIPs™), Fab and F(ab')$_2$ fragments, etc. Antibodies can be humanized, chimerized, deimmunized, or fully human. Numerous publications set forth the many types of antibodies and the methods of engineering such antibodies. For example, see U.S. Pat. Nos. 6,355,245; 6,180,370; 5,693,762; 6,407,213; 6,548,640; 5,565,332; 5,225,539; 6,103,889; and 5,260,203.

The genetically altered antibodies should be functionally equivalent to the above-mentioned natural antibodies. In certain embodiments, modified antibodies provide improved stability or/and therapeutic efficacy. Examples of modified antibodies include those with conservative substitutions of amino acid residues, and one or more deletions or additions of amino acids that do not significantly deleteriously alter the antigen binding utility. Substitutions can range from changing or modifying one or more amino acid residues to complete redesign of a region as long as the therapeutic utility is maintained. Antibodies of this application can be modified post-translationally (e.g., phosphorylation, and/or methylation) or can be modified synthetically (e.g., the attachment of a labeling group).

Antibodies with engineered or variant constant or Fc regions can be useful in modulating effector functions, such as, for example, antigen-dependent cytotoxicity (ADCC) and complement-dependent cytotoxicity (CDC). Such antibodies with engineered or variant constant or Fc regions may be useful in instances where a parent singling protein (Table 1 or Table 2) is expressed in normal tissue; variant antibodies without effector function in these instances may elicit the desired therapeutic response while not damaging normal tissue. Accordingly, certain aspects and methods of the present disclosure relate to antibodies with altered effector functions that comprise one or more amino acid substitutions, insertions, and/or deletions.

In certain embodiments, genetically altered antibodies are chimeric antibodies and humanized antibodies.

The chimeric antibody is an antibody having portions derived from different antibodies. For example, a chimeric antibody may have a variable region and a constant region derived from two different antibodies. The donor antibodies may be from different species. In certain embodiments, the variable region of a chimeric antibody is non-human, e.g., murine, and the constant region is human.

The genetically altered antibodies used in the disclosure include CDR grafted humanized antibodies. In one embodiment, the humanized antibody comprises heavy and/or light chain CDRs of a non-human donor immunoglobulin and heavy chain and light chain frameworks and constant regions of a human acceptor immunoglobulin. The method of making humanized antibody is disclosed in U.S. Pat. Nos. 5,530,101; 5,585,089; 5,693,761; 5,693,762; and 6,180,370 each of which is incorporated herein by reference in its entirety.

Antigen-binding fragments of the antibodies of the disclosure, which retain the binding specificity of the intact antibody, are also included in the disclosure. Examples of these antigen-binding fragments include, but are not limited to, partial or full heavy chains or light chains, variable regions, or CDR regions of any methylation or acetylation site-specific antibodies described herein.

In one embodiment of the disclosure, the antibody fragments are truncated chains (truncated at the carboxyl end). In certain embodiments, these truncated chains possess one or more immunoglobulin activities (e.g., complement fixation activity). Examples of truncated chains include, but are not limited to, Fab fragments (consisting of the VL, VH, CL and CH1 domains); Fd fragments (consisting of the VH and CH1 domains); Fv fragments (consisting of VL and VH domains of a single chain of an antibody); dAb fragments (consisting of a VH domain); isolated CDR regions; (Fab')$_2$ fragments, bivalent fragments (comprising two Fab fragments linked by a disulphide bridge at the hinge region). The truncated chains can be produced by conventional biochemical techniques, such as enzyme cleavage, or recombinant DNA techniques, each of which is known in the art. These polypeptide fragments may be produced by proteolytic cleavage of intact antibodies by methods well known in the art, or by inserting stop codons at the desired locations in the vectors using site-directed mutagenesis, such as after CH1 to produce Fab fragments or after the hinge region to produce (Fab')$_2$ fragments. Single chain antibodies may be produced by joining VL- and VH-coding regions with a DNA that encodes a peptide linker connecting the VL and VH protein fragments Papain digestion of antibodies produces two identical antigen-binding fragments, called "Fab" fragments, each with a single antigen-binding site, and a residual "Fc" fragment, whose name reflects its ability to crystallize readily. Pepsin treatment of an antibody yields an F(ab')$_2$ fragment that has two antigen-combining sites and is still capable of cross-linking antigen.

"Fv" usually refers to the minimum antibody fragment that contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the CDRs confer antigen-binding specificity to the antibody. However, even a single variable domain (or half of an Fv comprising three CDRs specific for an antigen) has the ability to recognize and bind antigen, although likely at a lower affinity than the entire binding site.

Thus, in certain embodiments, the antibodies of the application may comprise 1, 2, 3, 4, 5, 6, or more CDRs that recognize the methylation sites identified in Column F of Table 1 or acetylation sites identified in Column F of Table 2.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments that have hinge cysteines between them. Other chemical couplings of antibody fragments are also known.

"Single-chain Fv" or "scFv" antibody fragments comprise the $V_H$ and $V_L$ domains of an antibody, wherein these domains are present in a single polypeptide chain. In certain embodiments, the Fv polypeptide further comprises a polypeptide linker between the $V_H$ and $V_L$ domains that enables the scFv to form the desired structure for antigen binding. For a review of scFv see Pluckthun in The Pharmacology of Monoclonal Antibodies, vol. 113, Rosenburg and Moore, eds. (Springer-Verlag: New York, 1994), pp. 269-315.

SMIPs are a class of single-chain peptides engineered to include a target binding region and effector domain (CH2 and CH3 domains). See, e.g., U.S. Patent Application Publication No. 20050238646. The target binding region may be derived from the variable region or CDRs of an antibody, e.g., a methylation or acetylation site-specific antibody of the application. Alternatively, the target binding region is derived from a protein that binds a methylation or acetylation site.

Bispecific antibodies may be monoclonal, human or humanized antibodies that have binding specificities for at least two different antigens. In the present case, one of the binding specificities is for the methylation or acetylation site, the other one is for any other antigen, such as for example, a cell-surface protein or receptor or receptor subunit. Alternatively, a therapeutic agent may be placed on one arm. The therapeutic agent can be a drug, toxin, enzyme, DNA, radionuclide, etc.

In some embodiments, the antigen-binding fragment can be a diabody. The term "diabody" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90: 6444-6448 (1993).

Camelid antibodies refer to a unique type of antibodies that are devoid of light chain, initially discovered from animals of the camelid family. The heavy chains of these so-called heavy-chain antibodies bind their antigen by one single domain, the variable domain of the heavy immunoglobulin chain, referred to as VHH. VHHs show homology with the variable domain of heavy chains of the human VHIII family. The VHHs obtained from an immunized camel, dromedary, or llama have a number of advantages, such as effective production in microorganisms such as *Saccharomyces cerevisiae*.

In certain embodiments, single chain antibodies, and chimeric, humanized or primatized (CDR-grafted) antibodies, as well as chimeric or CDR-grafted single chain antibodies, comprising portions derived from different species, are also encompassed by the present disclosure as antigen-binding fragments of an antibody. The various portions of these antibodies can be joined together chemically by conventional techniques, or can be prepared as a contiguous protein using genetic engineering techniques. For example, nucleic acids encoding a chimeric or humanized chain can be expressed to produce a contiguous protein. See, e.g., U.S. Pat. Nos. 4,816,567 and 6,331,415; U.S. Pat. No. 4,816,397; European Patent No. 0,120,694; WO 86/01533; European Patent No. 0,194,276 B1; U.S. Pat. No. 5,225,539; and European Patent No. 0,239,400 B1. See also, Newman et al., BioTechnology, 10: 1455-1460 (1992), regarding primatized antibody. See, e.g., Ladner et al., U.S. Pat. No. 4,946,778; and Bird et al., Science, 242: 423-426 (1988)), regarding single chain antibodies.

In addition, functional fragments of antibodies, including fragments of chimeric, humanized, primatized or single chain antibodies, can also be produced. Functional fragments of the subject antibodies retain at least one binding function and/or modulation function of the full-length antibody from which they are derived.

Since the immunoglobulin-related genes contain separate functional regions, each having one or more distinct biological activities, the genes of the antibody fragments may be fused to functional regions from other genes (e.g., enzymes, U.S. Pat. No. 5,004,692, which is incorporated by reference in its entirety) to produce fusion proteins or conjugates having properties.

Non-immunoglobulin binding polypeptides are also contemplated. For example, CDRs from an antibody disclosed herein may be inserted into a suitable non-immunoglobulin scaffold to create a non-immunoglobulin binding polypeptide. Suitable candidate scaffold structures may be derived from, for example, members of fibronectin type III and cadherin superfamilies.

Also contemplated are other equivalent non-antibody molecules, such as protein binding domains or aptamers, which bind, in a methyl-specific or acetyl-specific manner, to an amino acid sequence comprising a methylation or acetylation site of the disclosure. See, e.g., Neuberger et al., Nature 312: 604 (1984). Aptamers are oligonucleic acid or peptide molecules that bind a specific target molecule. DNA or RNA aptamers are typically short oligonucleotides, engineered through repeated rounds of selection to bind to a molecular target. Peptide aptamers typically consist of a variable peptide loop attached at both ends to a protein scaffold. This double structural constraint generally increases the binding affinity of the peptide aptamer to levels comparable to an antibody (nanomolar range).

The disclosure also discloses the use of the methylation or acetylation site-specific antibodies with immunotoxins. Conjugates that are immunotoxins including antibodies have been widely described in the art. The toxins may be coupled to the antibodies by conventional coupling techniques or immunotoxins containing protein toxin portions can be produced as fusion proteins. In certain embodiments, antibody conjugates may comprise stable linkers and may release cytotoxic agents inside cells (see U.S. Pat. Nos. 6,867,007 and 6,884,869). The conjugates of the present application can be used in a corresponding way to obtain such immunotoxins. Illustrative of such immunotoxins are those described by Byers et al., Seminars Cell Biol 2:59-70 (1991) and by Fanger et al., Immunol Today 12:51-54 (1991). Exemplary immunotoxins include radiotherapeutic agents, ribosome-inactivating proteins (RIPs), chemotherapeutic agents, toxic peptides, or toxic proteins.

The methylation or acetylation site-specific antibodies disclosed in the disclosure may be used singly or in combination. The antibodies may also be used in an array format for high throughput uses. An antibody microarray is a collection of immobolized antibodies, typically spotted and fixed on a solid surface (such as glass, plastic and silicon chip).

In another aspect, the antibodies of the disclosure modulate at least one, or all, biological activities of a parent protein identified in Column B of Table 1 or Table 2. The biological activities of a parent protein identified in Column B of Table 1 or Table 2 include: 1) ligand binding activities (for instance, these neutralizing antibodies may be capable of competing with or completely blocking the binding of a parent signaling protein to at least one, or all, of its ligands; 2) signaling transduction activities, such as receptor dimerization, or arginine or lysine methylation; and 3) cellular responses induced by a parent signaling protein, such as oncogenic activities (e.g., cancer cell proliferation mediated by a parent signaling protein), and/or angiogenic activities.

In certain embodiments, the antibodies of the disclosure may have at least one activity selected from the group consisting of: 1) inhibiting cancer cell growth or proliferation; 2) inhibiting cancer cell survival; 3) inhibiting angiogenesis; 4) inhibiting cancer cell metastasis, adhesion, migration or invasion; 5) inducing apoptosis of cancer cells; 6) incorporating a toxic conjugate; and 7) acting as a diagnostic marker.

In certain embodiments, the methylation or acetylation site specific antibodies disclosed in the disclosure are especially indicated for diagnostic and therapeutic applications as described herein. Accordingly, the antibodies may be used in therapies, including combination therapies, in the diagnosis and prognosis of disease, as well as in the monitoring of disease progression. The disclosure, thus, further includes compositions comprising one or more embodiments of an antibody or an antigen binding portion of the disclosure as described herein. The composition may further comprise a pharmaceutically acceptable carrier. The composition may comprise two or more antibodies or antigen-binding portions, each with specificity for a different arginine or lysine methylation or acetylation site of the disclosure or two or more different antibodies or antigen-binding portions all of which are specific for the same arginine or lysine methylation or acetylation site of the disclosure. A composition of the disclosure may comprise one or more antibodies or antigen-binding portions of the disclosure and one or more additional reagents, diagnostic agents or therapeutic agents.

The present application provides for the polynucleotide molecules encoding the antibodies and antibody fragments and their analogs described herein. Because of the degeneracy of the genetic code, a variety of nucleic acid sequences encode each antibody amino acid sequence. The desired nucleic acid sequences can be produced by de novo solid-phase DNA synthesis or by PCR mutagenesis of an earlier prepared variant of the desired polynucleotide. In one embodiment, the codons that are used comprise those that are typical for human or mouse (see, e.g., Nakamura, Y., Nucleic Acids Res. 28: 292 (2000)).

The disclosure also features immortalized cell lines that produce an antibody of the disclosure. For example, hybridoma clones, constructed as described above, that produce monoclonal antibodies to the targeted signaling protein methylation sties disclosed herein are also provided. Similarly, the disclosure includes recombinant cells producing an antibody of the disclosure, which cells may be constructed by well known techniques; for example the antigen combining site of the monoclonal antibody can be cloned by PCR and single-chain antibodies produced as phage-displayed recombinant antibodies or soluble antibodies in *E. coli* (see, e.g., ANTIBODY ENGINEERING PROTOCOLS, 1995, Humana Press, Sudhir Paul editor.)

Methods of Making Methylation or Acetylation Site-Specific Antibodies

In another aspect, the disclosure features a method for making methylation or acetylation site-specific antibodies.

Polyclonal antibodies of the disclosure may be produced according to standard techniques by immunizing a suitable animal (e.g., rabbit, goat, etc.) with an antigen comprising a arginine and/or lysine methylation or acetylation site of the disclosure. (i.e. a methylation shown in Table 1 or acetylation site shown in Table 2) in either the methylated or unmethylated state, depending upon the desired specificity of the antibody, collecting immune serum from the animal, and separating the polyclonal antibodies from the immune serum, in accordance with known procedures and screening and isolating a polyclonal antibody specific for the arginine or lysine methylation or acetylation site of interest as further described below. Methods for immunizing non-human animals such as mice, rats, sheep, goats, pigs, cattle and horses are well known in the art. See, e.g., Harlow and Lane, *Antibodies: A Laboratory Manual*, New York: Cold Spring Harbor Press, 1990.

The immunogen may be the full length protein or a peptide comprising the arginine or lysine methylation or acetylation site of interest. In some embodiments the immunogen is a peptide of from 7 to 20 amino acids in length, e.g., about 8 to 17 amino acids in length. In some embodiments, the peptide antigen will comprise about 3 to 8 amino acids on each side of the phosphorylatable arginine or lysine. In yet other embodiments, the peptide antigen desirably will comprise four or more amino acids flanking each side of the phosphorylatable amino acid and encompassing it. Peptide antigens suitable for producing antibodies of the disclosure may be designed, constructed and employed in accordance with well-known techniques. See, e.g., Antibodies: A Laboratory Manual, Chapter 5, p. 75-76, Harlow & Lane Eds., Cold Spring Harbor Laboratory (1988); Czernik, *Methods In Enzymology*, 201: 264-283 (1991); Merrifield, *J. Am. Chem. Soc.* 85: 21-49 (1962)).

Suitable peptide antigens may comprise all or partial sequence of a trypsin-digested fragment as set forth in Column F of Table 1 or Table 2. Suitable peptide antigens may also comprise all or partial sequence of a peptide fragment produced by another protease digestion.

Exemplary immunogens are those that comprise a methylation site of a protein in Table 1 or acetylation site of a protein in Table 2 that is a secreted protein, adaptor/scaffold protein, non-receptor ser/thr protein kinase, non-receptor tyrosine protein kinase, chromatin/DNA binding/repair/replication protein, cytoskeletal protein, mitochondrial protein, transcriptional regulator, translational regulator, cell cycle regulation protein, RNA processing protein, adhesion or extracellular matrix protein, proteases, kinases (or regulatory subunit thereof), apoptosis protein, chaperone protein, receptor/channel/transporter/cell surface protein, enzyme, G protein or regulator protein, endoplasmic reticulum or golgi protein, calcium-binding protein, vesicle proteins, motor or contractile protein, non-protein kinase, phosphatase, or a protein of unknown function.

In some embodiments the immunogen is administered with an adjuvant. Suitable adjuvants will be well known to those of skill in the art. Exemplary adjuvants include complete or incomplete Freund's adjuvant, RIBI (muramyl dipeptides) or ISCOM (immunostimulating complexes).

When the above-described methods are used for producing polyclonal antibodies, following immunization, the polyclonal antibodies which secreted into the bloodstream can be recovered using known techniques. Purified forms of these antibodies can, of course, be readily prepared by standard purification techniques, such as for example, affinity chromatography with Protein A, anti-immunoglobulin, or the antigen itself. In any case, in order to monitor the success of immunization, the antibody levels with respect to the antigen in serum will be monitored using standard techniques such as ELISA, RIA and the like.

Monoclonal antibodies of the disclosure may be produced by any of a number of means that are well-known in the art. In some embodiments, antibody-producing B cells are isolated from an animal immunized with a peptide antigen as described above. The B cells may be from the spleen, lymph nodes or peripheral blood. Individual B cells are isolated and screened as described below to identify cells producing an antibody specific for the arginine or lysine methylation or acetylation site of interest. Identified cells are then cultured to produce a monoclonal antibody of the disclosure.

Alternatively, a monoclonal methylation or acetylation site-specific antibody of the disclosure may be produced using standard hybridoma technology, in a hybridoma cell line according to the well-known technique of Kohler and Milstein. See *Nature* 265: 495-97 (1975); Kohler and Milstein, *Eur. J. Immunol.* 6: 511 (1976); see also, Current Protocols in Molecular Biology, Ausubel et al. Eds. (1989). Monoclonal antibodies so produced are highly specific, and improve the selectivity and specificity of diagnostic assay methods provided by the disclosure. For example, a solution containing the appropriate antigen may be injected into a mouse or other species and, after a sufficient time (in keeping with conventional techniques), the animal is sacrificed and spleen cells obtained. The spleen cells are then immortalized by any of a number of standard means. Methods of immortalizing cells include, but are not limited to, transfecting them with oncogenes, infecting them with an oncogenic virus and cultivating them under conditions that select for immortalized cells, subjecting them to carcinogenic or mutating compounds, fusing them with an immortalized cell, e.g., a myeloma cell, and inactivating a tumor suppressor gene. See, e.g., Harlow and Lane, supra. If fusion with myeloma cells is used, the myeloma cells preferably do not secrete immunoglobulin polypeptides (a non-secretory cell line). Typically the antibody producing cell and the immortalized cell (such as but not limited to myeloma cells) with which it is fused are from the same species. Rabbit fusion hybridomas, for example, may be produced as described in U.S. Pat. No. 5,675,063. The immortalized antibody producing cells, such as hybridoma cells, are then grown in a suitable selection media, such as hypoxanthine-aminopterin-thymidine (HAT), and the supernatant screened for monoclonal antibodies having the desired specificity, as described below. The secreted antibody may be recovered from tissue culture supernatant by conventional methods such as precipitation, ion exchange or affinity chromatography, or the like.

The disclosure also encompasses antibody-producing cells and cell lines, such as hybridomas, as described above.

Polyclonal or monoclonal antibodies may also be obtained through in vitro immunization. For example, phage display techniques can be used to provide libraries containing a repertoire of antibodies with varying affinities for a particular antigen. Techniques for the identification of high affinity human antibodies from such libraries are described by Griffiths et al., (1994) *EMBO J.*, 13:3245-3260; Nissim et al., ibid, pp. 692-698 and by Griffiths et al., ibid, 12:725-734, which are incorporated by reference.

The antibodies may be produced recombinantly using methods well known in the art for example, according to the methods disclosed in U.S. Pat. No. 4,349,893 (Reading) or U.S. Pat. No. 4,816,567 (Cabilly et al.) The antibodies may also be chemically constructed by specific antibodies made according to the method disclosed in U.S. Pat. No. 4,676,980 (Segel et al.)

Once a desired methylation or acetylation site-specific antibody is identified, polynucleotides encoding the antibody, such as heavy, light chains or both (or single chains in the case of a single chain antibody) or portions thereof such as those encoding the variable region, may be cloned and isolated from antibody-producing cells using means that are well known in the art. For example, the antigen combining site of the monoclonal antibody can be cloned by PCR and single-chain antibodies produced as phage-displayed recombinant antibodies or soluble antibodies in E. coli (see, e.g., Antibody Engineering Protocols, 1995, Humana Press, Sudhir Paul editor.)

Accordingly, in a further aspect, the disclosure features such nucleic acids encoding the heavy chain, the light chain, a variable region, a framework region or a CDR of an antibody of the disclosure. In some embodiments, the nucleic acids are operably linked to expression control sequences. The disclosure, thus, also features vectors and expression control sequences useful for the recombinant expression of an antibody or antigen-binding portion thereof of the disclosure. Those of skill in the art will be able to choose vectors and expression systems that are suitable for the host cell in which the antibody or antigen-binding portion is to be expressed.

Monoclonal antibodies of the disclosure may be produced recombinantly by expressing the encoding nucleic acids in a suitable host cell under suitable conditions. Accordingly, the disclosure further features host cells comprising the nucleic acids and vectors described above.

Monoclonal Fab fragments may also be produced in *Escherichia coli* by recombinant techniques known to those skilled in the art. See, e.g., W. Huse, *Science* 246: 1275-81 (1989); Mullinax et al., *Proc. Nat'l Acad. Sci.* 87: 8095 (1990).

If monoclonal antibodies of a single desired isotype are desired for a particular application, particular isotypes can be prepared directly, by selecting from the initial fusion, or prepared secondarily, from a parental hybridoma secreting a monoclonal antibody of different isotype by using the sib selection technique to isolate class-switch variants (Steplewski, et al., *Proc. Nat'l. Acad. Sci.,* 82: 8653 (1985); Spira et al., *J. Immunol. Methods,* 74: 307 (1984)). Alternatively, the isotype of a monoclonal antibody with desirable propertied can be changed using antibody engineering techniques that are well-known in the art.

Methylation or acetylation site-specific antibodies of the disclosure, whether polyclonal or monoclonal, may be screened for epitope and methyl or acetyl-specificity according to standard techniques. See, e.g., Czernik et al., *Methods in Enzymology,* 201: 264-283 (1991). For example, the antibodies may be screened against the methylated and/or unmethylated peptide library by ELISA to ensure specificity for both the desired antigen (i.e. that epitope including an methylation or acetylation site of the disclosure and for reactivity only with the methylated (or unmethylated) form of the antigen. Peptide competition assays may be carried out to confirm lack of reactivity with other methyl-epitopes on the parent protein. The antibodies may also be tested by Western blotting against cell preparations containing the parent signaling protein, e.g., cell lines over-expressing the parent protein, to confirm reactivity with the desired methylated or acetylated epitope/target.

Specificity against the desired methylated epitope may also be examined by constructing mutants lacking methylatable residues at positions outside the desired epitope that are known to be methylated, or by mutating the desired methyl-epitope and confirming lack of reactivity. Methylation or acetylation site-specific antibodies of the disclosure may exhibit some limited cross-reactivity to related epitopes in non-target proteins. This is not unexpected as most antibodies exhibit some degree of cross-reactivity, and anti-peptide antibodies will often cross-react with epitopes having high homology to the immunizing peptide. See, e.g., Czernik, supra. Cross-reactivity with non-target proteins is readily characterized by Western blotting alongside markers of known molecular weight. Amino acid sequences of cross-reacting proteins may be examined to identify methylation or acetylation sites with flanking sequences that are highly homologous to that of a methylation or acetylation site of the disclosure.

In certain cases, polyclonal antisera may exhibit some undesirable general cross-reactivity to methyl-lysine, methyl-arginine, or acetyl-lysine itself, which may be removed by further purification of antisera, e.g., over a methyl-lysine, methyl-arginine, or acetyl-lysine column. Antibodies of the disclosure specifically bind their target protein (i.e. a protein listed in Column B of Table 1 or Table 2) only when methylated or acetylated (or only when not methylated or not acetylated, as the case may be) at the site disclosed in corresponding Columns E/F, and do not (substantially) bind to the other form (as compared to the form for which the antibody is specific).

Antibodies may be further characterized via immunohistochemical (IHC) staining using normal and diseased tissues to examine methylation and activation state and level of a methylation or acetylation site in diseased tissue. IHC may be carried out according to well-known techniques. See, e.g., Antibodies: A Laboratory Manual, Chapter 10, Harlow & Lane Eds., Cold Spring Harbor Laboratory (1988). Briefly, paraffin-embedded tissue (e.g., tumor tissue) is prepared for immunohistochemical staining by deparaffinizing tissue sections with xylene followed by ethanol; hydrating in water then PBS; unmasking antigen by heating slide in sodium citrate buffer; incubating sections in hydrogen peroxide; blocking in blocking solution; incubating slide in primary antibody and secondary antibody; and finally detecting using ABC avidin/biotin method according to manufacturer's instructions.

Antibodies may be further characterized by flow cytometry carried out according to standard methods. See Chow et al., *Cytometry (Communications in Clinical Cytometry)* 46: 72-78 (2001). Briefly and by way of example, the following protocol for cytometric analysis may be employed: samples may be centrifuged on Ficoll gradients to remove lysed erythrocytes and cell debris. Adherring cells may be scrapped off plates and washed with PBS. Cells may then be fixed with 2% paraformaldehyde for 10 minutes at 37° C. followed by permeabilization in 90% methanol for 30 minutes on ice. Cells may then be stained with the primary methylation or acetylation site-specific antibody of the disclosure (which detects a parent signaling protein enumerated in Table 1 or Table 2), washed and labeled with a fluorescent-labeled secondary antibody. Additional fluorochrome-conjugated marker antibodies (e.g., CD45, CD34) may also be added at this time to aid in the subsequent identification of specific hematopoietic cell types. The cells would then be analyzed on a flow cytometer (e.g. a Beckman Coulter FC500) according to the specific protocols of the instrument used.

Antibodies of the disclosure may also be advantageously conjugated to fluorescent dyes (e.g. Alexa488, PE) for use in multi-parametric analyses along with other signal transduction (phospho-CrkL, phospho-Erk 1/2) and/or cell marker (CD34) antibodies.

Methylation or acetylation site-specific antibodies of the disclosure may specifically bind to a signaling protein or polypeptide listed in Table 1 only when methylated or to a signaling protein or polypeptide listed in Table 2 only when acetylated at the specified arginine or lysine residue, but are not limited only to binding to the listed signaling proteins of human species, per se. The disclosure includes antibodies that also bind conserved and highly homologous or identical methylation or acetylation sites in respective signaling proteins from other species (e.g., mouse, rat, monkey, yeast), in addition to binding the methylation or acetylation site of the human homologue. The term "homologous" refers to two or more sequences or subsequences that have at least about 85%, at least 90%, at least 95%, or higher nucleotide or amino acid residue identity, when compared and aligned for maximum correspondence, as measured using sequence comparison method (e.g., BLAST) and/or by visual inspection. Highly homologous or identical sites conserved in other species can readily be identified by standard sequence comparisons (such as BLAST).

Methods for making bispecific antibodies are within the purview of those skilled in the art. Traditionally, the recombinant production of bispecific antibodies is based on the co-expression of two immunoglobulin heavy-chain/light-chain pairs, where the two heavy chains have different specificities (Milstein and Cuello, Nature, 305:537-539 (1983)). Antibody variable domains with the desired binding specificities (antibody-antigen combining sites) can be fused to immunoglobulin constant domain sequences. In certain embodiments, the fusion is with an immunoglobulin heavy-chain constant domain, including at least part of the hinge, CH2, and CH3 regions. DNAs encoding the immunoglobulin heavy-chain fusions and, if desired, the immunoglobulin light chain, are inserted into separate expression vectors, and are co-transfected into a suitable host organism. For further details of illustrative currently known methods for generating bispecific antibodies see, for example, Suresh et al., Methods in Enzymology, 121:210 (1986); WO 96/27011; Brennan et al., Science 229:81 (1985); Shalaby et al., J. Exp. Med. 175:217-225 (1992); Kostelny et al., J. Immunol. 148(5):1547-1553 (1992); Hollinger et al., Proc. Natl. Acad. Sci. USA 90:6444-6448 (1993); Gruber et al., J. Immunol. 152:5368 (1994); and Tuft et al., J. Immunol. 147:60 (1991). Bispecific antibodies also include cross-linked or heteroconjugate antibodies. Heteroconjugate antibodies may be made using any convenient cross-linking methods. Suitable cross-linking agents are well known in the art, and are disclosed in U.S. Pat. No. 4,676,980, along with a number of cross-linking techniques.

Various techniques for making and isolating bispecific antibody fragments directly from recombinant cell culture have also been described. For example, bispecific antibodies have been produced using leucine zippers. Kostelny et al., J. Immunol., 148(5):1547-1553 (1992). The leucine zipper peptides from the Fos and Jun proteins may be linked to the Fab' portions of two different antibodies by gene fusion. The antibody homodimers may be reduced at the hinge region to form monomers and then re-oxidized to form the antibody heterodimers. This method can also be utilized for the production of antibody homodimers. A strategy for making bispecific antibody fragments by the use of single-chain Fv (scFv) dimers has also been reported. See Gruber et al., J. Immunol., 152:5368 (1994). Alternatively, the antibodies can be "linear antibodies" as described in Zapata et al. Protein Eng. 8(10):1057-1062 (1995). Briefly, these antibodies comprise a pair of tandem Fd segments ($V_H$-$C_H$1-$V_H$-$C_H$1) which form a pair of antigen binding regions. Linear antibodies can be bispecific or monospecific.

To produce the chimeric antibodies, the portions derived from two different species (e.g., human constant region and murine variable or binding region) can be joined together chemically by conventional techniques or can be prepared as single contiguous proteins using genetic engineering techniques. The DNA molecules encoding the proteins of both the light chain and heavy chain portions of the chimeric antibody can be expressed as contiguous proteins. The method of making chimeric antibodies is disclosed in U.S. Pat. No. 5,677,427; U.S. Pat. No. 6,120,767; and U.S. Pat. No. 6,329,508, each of which is incorporated by reference in its entirety.

Fully human antibodies may be produced by a variety of techniques. One example is trioma methodology. The basic approach and an exemplary cell fusion partner, SPAZ-4, for use in this approach have been described by Oestberg et al., Hybridoma 2:361-367 (1983); Oestberg, U.S. Pat. No. 4,634,664; and Engleman et al., U.S. Pat. No. 4,634,666 (each of which is incorporated by reference in its entirety).

Human antibodies can also be produced from non-human transgenic animals having transgenes encoding at least a segment of the human immunoglobulin locus. The production and properties of animals having these properties are described in detail by, see, e.g., Lonberg et al., WO93/12227; U.S. Pat. No. 5,545,806; and Kucherlapati, et al., WO91/10741; U.S. Pat. No. 6,150,584, which are herein incorporated by reference in their entirety.

Various recombinant antibody library technologies may also be utilized to produce fully human antibodies. For example, one approach is to screen a DNA library from human B cells according to the general protocol outlined by Huse et al., Science 246:1275-1281 (1989). The protocol described by Huse is rendered more efficient in combination with phage-display technology. See, e.g., Dower et al., WO 91/17271 and McCafferty et al., WO 92/01047; U.S. Pat. No. 5,969,108, (each of which is incorporated by reference in its entirety).

Eukaryotic ribosome can also be used as means to display a library of antibodies and isolate the binding human antibodies by screening against the target antigen, as described in Coia G, et al., J. Immunol. Methods 1: 254 (1-2):191-7 (2001); Hanes J. et al., Nat. Biotechnol. 18(12):1287-92 (2000); Proc. Natl. Acad. Sci. U.S.A. 95(24):14130-5 (1998); Proc. Natl. Acad. Sci. U.S.A. 94(10):4937-42 (1997), each which is incorporated by reference in its entirety.

The yeast system is also suitable for screening mammalian cell-surface or secreted proteins, such as antibodies. Antibody libraries may be displayed on the surface of yeast cells for the purpose of obtaining the human antibodies against a target antigen. This approach is described by Yeung, et al., Biotechnol. Prog. 18(2):212-20 (2002); Boeder, E. T., et al., Nat. Biotechnol. 15(6):553-7 (1997), each of which is herein incorporated by reference in its entirety. Alternatively, human antibody libraries may be expressed intracellularly and screened via the yeast two-hybrid system (WO0200729A2, which is incorporated by reference in its entirety).

Recombinant DNA techniques can be used to produce the recombinant methylation or acetylation site-specific antibodies described herein, as well as the chimeric or humanized methylation or acetylation site-specific antibodies, or any other genetically-altered antibodies and the fragments or conjugate thereof in any expression systems including both prokaryotic and eukaryotic expression systems, such as bacteria, yeast, insect cells, plant cells, mammalian cells (for example, NSO cells).

Once produced, the whole antibodies, their dimers, individual light and heavy chains, or other immunoglobulin forms of the present application can be purified according to standard procedures of the art, including ammonium sulfate precipitation, affinity columns, column chromatography, gel electrophoresis and the like (see, generally, Scopes, R., Protein Purification (Springer-Verlag, N.Y., 1982)). Once purified, partially or to homogeneity as desired, the polypeptides may then be used therapeutically (including extracorporeally) or in developing and performing assay procedures, immunofluorescent staining, and the like. (See, generally, Immunological Methods, Vols. I and II (Lefkovits and Pernis, eds., Academic Press, NY, 1979 and 1981).

Therapeutic Uses

In a further aspect, the disclosure features methods and compositions for therapeutic uses of the peptides or proteins comprising a methylation or acetylation site of the disclosure, and methylation or acetylation site-specific antibodies of the disclosure.

In one embodiment, the disclosure features for a method of treating or preventing cancer in a subject, wherein the cancer is associated with the methylation or acetylation state of a methylation in Table 1 or acetylation site in Table 2, whether methylated or demethylated, comprising: administering to a subject in need thereof a therapeutically effective amount of a peptide comprising a methylation or acetylation site (Table 1 or Table 2) and/or an antibody or antigen-binding fragment thereof that specifically bind a methylation or acetylation site of the disclosure (Table 1 or Table 2). The antibodies maybe full-length antibodies, genetically engineered antibodies, antibody fragments, and antibody conjugates of the disclosure.

The term "subject" refers to a vertebrate, such as for example, a mammal, or a human. Although present application are primarily concerned with the treatment of human subjects, the disclosed methods may also be used for the treatment of other mammalian subjects such as dogs and cats for veterinary purposes.

In one aspect, the disclosure features a method of treating cancer in which a peptide or an antibody that reduces at least one biological activity of a targeted signaling protein is administered to a subject. For example, the peptide or the antibody administered may disrupt or modulate the interaction of the target signaling protein with its ligand. Alternatively, the peptide or the antibody may interfere with, thereby reducing, the down-stream signal transduction of the parent signaling protein. An antibody that specifically binds the arginine or lysine methylation or acetylation site only when the arginine or lysine is methylated or acetylated, and that does not substantially bind to the same sequence when the arginine or lysine is not methylated or acetylated, thereby prevents downstream signal transduction triggered by an methyl-arginine or lysine or acetyl-lysine. Alternatively, an antibody that specifically binds the unmethylated target methylation or acetylation site reduces the methylation or acetylation at that site and thus reduces activation of the protein mediated by methylation or acetylation of that site. Similarly, an unmethylated or unacetylated peptide may compete with an endogenous methylation or acetylation site for same kinases, thereby preventing or reducing the methylation of the endogenous target protein. Alternatively, a peptide comprising a methylated arginine or lysine site of the disclosure but lacking the ability to trigger signal transduction may competitively inhibit interaction of the endogenous protein with the same down-stream ligand(s).

The antibodies of the disclosure may also be used to target cancer cells for effector-mediated cell death. The antibody disclosed herein may be administered as a fusion molecule that includes a methylation or acetylation site-targeting portion joined to a cytotoxic moiety to directly kill cancer cells. Alternatively, the antibody may directly kill the cancer cells through complement-mediated or antibody-dependent cellular cytotoxicity.

Accordingly in one embodiment, the antibodies of the present disclosure may be used to deliver a variety of cytotoxic compounds. Any cytotoxic compound can be fused to the present antibodies. The fusion can be achieved chemically or genetically (e.g., via expression as a single, fused molecule). The cytotoxic compound can be a biological, such as a polypeptide, or a small molecule. As those skilled in the art will appreciate, for small molecules, chemical fusion is used, while for biological compounds, either chemical or genetic fusion can be used.

Non-limiting examples of cytotoxic compounds include therapeutic drugs, radiotherapeutic agents, ribosome-inactivating proteins (RIPs), chemotherapeutic agents, toxic small molecules, toxic peptides, toxic proteins, and mixtures thereof. The cytotoxic drugs can be intracellularly acting cytotoxic drugs, such as short-range radiation emitters, including, for example, short-range, high-energy α-emitters. Enzymatically active toxins and fragments thereof, including ribosome-inactivating proteins, are exemplified by saporin, luffin, momordins, ricin, trichosanthin, gelonin, abrin, etc. Procedures for preparing enzymatically active polypeptides of the immunotoxins are described in WO84/03508 and WO85/03508, which are hereby incorporated by reference. Certain cytotoxic moieties are derived from adriamycin, chlorambucil, daunomycin, methotrexate, neocarzinostatin, and platinum, for example.

Exemplary chemotherapeutic agents that may be attached to an antibody or antigen-binding fragment thereof include taxol, doxorubicin, verapamil, podophyllotoxin, procarbazine, mechlorethamine, cyclophosphamide, camptothecin, ifosfamide, melphalan, chlorambucil, bisulfan, nitrosurea, dactinomycin, daunorubicin, doxorubicin, bleomycin, plicomycin, mitomycin, etoposide (VP16), tamoxifen, transplatinum, 5-fluorouracil, vincristin, vinblastin, or methotrexate.

Procedures for conjugating the antibodies with the cytotoxic agents have been previously described and are within the purview of one skilled in the art.

Alternatively, the antibody can be coupled to high energy radiation emitters, for example, a radioisotope, such as $^{131}$I, a γ-emitter, which, when localized at the tumor site, results in a killing of several cell diameters. See, e.g., S. E. Order, "Analysis, Results, and Future Prospective of the Therapeutic Use of Radiolabeled Antibody in Cancer Therapy", Monoclonal Antibodies for Cancer Detection and Therapy, Baldwin et al. (eds.), pp. 303-316 (Academic Press 1985), which is hereby incorporated by reference. Other suitable radioisotopes include α-emitters, such as $^{212}$Bi, $^{213}$Bi, and $^{211}$At, and β-emitters, such as $^{186}$Re and $^{90}$Y.

Because many of the signaling proteins in which arginine or lysine methylation or acetylation sites of the disclosure occur also are expressed in normal cells and tissues, it may also be advantageous to administer a methylation or acetylation site-specific antibody with a constant region modified to reduce or eliminate ADCC or CDC to limit damage to normal cells. For example, effector function of antibodies may be reduced or eliminated by utilizing an IgG1 constant domain instead of an IgG2/4 fusion domain. Other ways of eliminating effector function can be envisioned such as, e.g., mutation of the sites known to interact with FcR or insertion of a peptide in the hinge region, thereby eliminating critical sites required for FcR interaction. Variant antibodies with reduced or no effector function also include variants as described previously herein.

The peptides and antibodies of the disclosure may be used in combination with other therapies or with other agents. Other agents include but are not limited to polypeptides, small molecules, chemicals, metals, organometallic compounds, inorganic compounds, nucleic acid molecules, oligonucleotides, aptamers, spiegelmers, antisense nucleic acids, locked nucleic acid (LNA) inhibitors, peptide nucleic acid (PNA) inhibitors, immunomodulatory agents, antigen-binding fragments, prodrugs, and peptidomimetic compounds. In certain embodiments, the antibodies and peptides of the disclosure may be used in combination with cancer therapies known to one of skill in the art.

In certain aspects, the present disclosure relates to combination treatments comprising a methylation or acetylation site-specific antibody described herein and immunomodulatory compounds, vaccines or chemotherapy. Illustrative examples of suitable immunomodulatory agents that may be used in such combination therapies include agents that block negative regulation of T cells or antigen presenting cells (e.g., anti-CTLA4 antibodies, anti-PD-L1 antibodies, anti-PDL-2 antibodies, anti-PD-1 antibodies and the like) or agents that enhance positive co-stimulation of T cells (e.g., anti-CD40 antibodies or anti 4-1BB antibodies) or agents that increase NK cell number or T-cell activity (e.g., inhibitors such as IMiDs, thalidomide, or thalidomide analogs). Furthermore, immunomodulatory therapy could include cancer vaccines such as dendritic cells loaded with tumor cells, proteins, peptides, RNA, or DNA derived from such cells, patient derived heat-shock proteins (hsp's) or general adjuvants stimulating the immune system at various levels such as CpG, Luivac®, Biostim®, Ribomunyl®, Imudon®, Bronchovaxom® or any other compound or other adjuvant activating receptors of the innate immune system (e.g., toll like receptor agonist, anti-CTLA-4 antibodies, etc.). Also, immunomodulatory therapy could include treatment with cytokines such as IL-2, GM-CSF and IFN-gamma.

Furthermore, combination of antibody therapy with chemotherapeutics could be particularly useful to reduce overall tumor burden, to limit angiogenesis, to enhance tumor accessibility, to enhance susceptibility to ADCC, to result in increased immune function by providing more tumor antigen, or to increase the expression of the T cell attractant LIGHT.

Pharmaceutical compounds that may be used for combinatory anti-tumor therapy include, merely to illustrate: aminoglutethimide, amsacrine, anastrozole, asparaginase, bcg, bicalutamide, bleomycin, buserelin, busulfan, camptothecin, capecitabine, carboplatin, carmustine, chlorambucil, cisplatin, cladribine, clodronate, colchicine, cyclophosphamide, cyproterone, cytarabine, dacarbazine, dactinomycin, daunorubicin, dienestrol, diethylstilbestrol, docetaxel, doxorubicin, epirubicin, estradiol, estramustine, etoposide, exemestane, filgrastim, fludarabine, fludrocortisone, fluorouracil, fluoxymesterone, flutamide, gemcitabine, genistein, goserelin, hydroxyurea, idarubicin, ifosfamide, imatinib, interferon, irinotecan, letrozole, leucovorin, leuprolide, levamisole, lomustine, mechlorethamine, medroxyprogesterone, megestrol, melphalan, mercaptopurine, mesna, methotrexate, mitomycin, mitotane, mitoxantrone, nilutamide, nocodazole, octreotide, oxaliplatin, paclitaxel, pamidronate, pentostatin, plicamycin, porfimer, procarbazine, raltitrexed, rituximab, streptozocin, suramin, tamoxifen, temozolomide, teniposide, testosterone, thioguanine, thiotepa, titanocene dichloride, topotecan, trastuzumab, tretinoin, vinblastine, vincristine, vindesine, and vinorelbine.

These chemotherapeutic anti-tumor compounds may be categorized by their mechanism of action into groups, including, for example, the following classes of agents: anti-metabolites/anti-cancer agents, such as pyrimidine analogs (5-fluorouracil, floxuridine, capecitabine, gemcitabine and cytarabine) and purine analogs, folate inhibitors and related inhibitors (mercaptopurine, thioguanine, pentostatin and 2-chlorodeoxyadenosine (cladribine)); antiproliferative/antimitotic agents including natural products such as vinca alkaloids (vinblastine, vincristine, and vinorelbine), microtubule disruptors such as taxane (paclitaxel, docetaxel), vincristine, vinblastine, nocodazole, epothilones and navelbine, epidipodophyllotoxins (etoposide, teniposide), DNA damaging agents (actinomycin, amsacrine, anthracyclines, bleomycin, busulfan, camptothecin, carboplatin, chlorambucil, cisplatin, cyclophosphamide, cytoxan, dactinomycin, daunorubicin, doxorubicin, epirubicin, hexamethylmelamineoxaliplatin, iphosphamide, melphalan, mechlorethamine, mitomycin, mitoxantrone, nitrosourea, plicamycin, procarbazine, taxol, taxotere, teniposide, triethylenethiophosphoramide and etoposide (VP16)); antibiotics such as dactinomycin (actinomycin D), daunorubicin, doxorubicin (adriamycin), idarubicin, anthracyclines, mitoxantrone, bleomycins, plicamycin (mithramycin) and mitomycin; enzymes (L-asparaginase which systemically metabolizes L-asparagine and deprives cells which do not have the capacity to synthesize their own asparagine); antiplatelet agents; antiproliferative/antimitotic alkylating agents such as nitrogen mustards (mechlorethamine, cyclophosphamide and analogs, melphalan, chlorambucil), ethylenimines and methylmelamines (hexamethylmelamine and thiotepa), alkyl sulfonates-busulfan, nitrosoureas (carmustine (BCNU) and analogs, streptozocin), trazenes-dacarbazinine (DTIC); antiproliferative/antimitotic antimetabolites such as folic acid analogs (methotrexate); platinum coordination complexes (cisplatin, carboplatin), procarbazine, hydroxyurea, mitotane, aminoglutethimide; hormones, hormone analogs (estrogen, tamoxifen, goserelin, bicalutamide, nilutamide) and aromatase inhibitors (letrozole, anastrozole); anticoagulants (heparin, synthetic heparin salts and other inhibitors of thrombin); fibrinolytic agents (such as tissue plasminogen activator, streptokinase and urokinase), aspirin, dipyridamole, ticlopidine, clopidogrel, abciximab; antimigratory agents; antisecretory agents (breveldin); immunosuppressives (cyclosporine, tacrolimus (FK-506), sirolimus (rapamycin), azathioprine, mycophenolate mofetil); immuno-modulatory agents (thalidomide and analogs thereof such as lenalidomide (Revlimid, CC-5013) and CC-4047 (Actimid)), cyclophosphamide; anti-angiogenic compounds (TNP-470, genistein) and growth factor inhibitors (vascular endothelial growth factor (VEGF) inhibitors, fibroblast growth factor (FGF) inhibitors); angiotensin receptor blocker; nitric oxide donors; anti-sense oligonucleotides; antibodies (trastuzumab); cell cycle inhibitors and differentiation inducers (tretinoin); mTOR inhibitors, topoisomerase inhibitors (doxorubicin (adriamycin), amsacrine, camptothecin, daunorubicin, dactinomycin, eniposide, epirubicin, etoposide, idarubicin and mitoxantrone, topotecan, irinotecan), corticosteroids (cortisone, dexamethasone, hydrocortisone, methylprednisolone, prednisone, and prenisolone);

growth factor signal transduction kinase inhibitors; mitochondrial dysfunction inducers and caspase activators; and chromatin disruptors.

In certain embodiments, pharmaceutical compounds that may be used for combinatory anti-angiogenesis therapy include: (1) inhibitors of release of "angiogenic molecules," such as bFGF (basic fibroblast growth factor); (2) neutralizers of angiogenic molecules, such as anti-βbFGF antibodies; and (3) inhibitors of endothelial cell response to angiogenic stimuli, including collagenase inhibitor, basement membrane turnover inhibitors, angiostatic steroids, fungal-derived angiogenesis inhibitors, platelet factor 4, thrombospondin, arthritis drugs such as D-penicillamine and gold thiomalate, vitamin $D_3$ analogs, alpha-interferon, and the like. For additional proposed inhibitors of angiogenesis, see Blood et al., Biochim. Biophys. Acta, 1032:89-118 (1990), Moses et al., Science, 248:1408-1410 (1990), Ingber et al., Lab. Invest., 59:44-51 (1988), and U.S. Pat. Nos. 5,092,885, 5,112,946, 5,192,744, 5,202,352, and 6,573,256. In addition, there are a wide variety of compounds that can be used to inhibit angiogenesis, for example, peptides or agents that block the VEGF-mediated angiogenesis pathway, endostatin protein or derivatives, arginine or lysine binding fragments of angiostatin, melanin or melanin-promoting compounds, plasminogen fragments (e.g., Kringles 1-3 of plasminogen), troponin subunits, inhibitors of vitronectin $\alpha_v\beta_3$, peptides derived from Saposin B, antibiotics or analogs (e.g., tetracycline or neomycin), dienogest-containing compositions, compounds comprising a MetAP-2 inhibitory core coupled to a peptide, the compound EM-138, chalcone and its analogs, and naaladase inhibitors. See, for example, U.S. Pat. Nos. 6,395,718, 6,462,075, 6,465,431, 6,475,784, 6,482,802, 6,482,810, 6,500,431, 6,500,924, 6,518,298, 6,521,439, 6,525,019, 6,538,103, 6,544,758, 6,544,947, 6,548,477, 6,559,126, and 6,569,845.

Diagnostic Uses

In a further aspect, the disclosure features methods for detecting and quantitating methylation or acetylation at an arginine or lysine methylation or acetylation site of the disclosure. For example, peptides, including AQUA peptides of the disclosure, and antibodies of the disclosure are useful in diagnostic and prognostic evaluation of cancer, wherein the particular cancer is associated with the methylation or acetylation state of a methylation in Table 1 or acetylation site in Table 2, whether methylated or demethylated.

Methods of diagnosis can be performed in vitro using a biological sample (e.g., blood sample, lymph node biopsy or tissue) from a subject, or in vivo. The methylation state or level at the arginine or lysine residue identified in the corresponding row in Column E of Table 1 or acetylation state or level at the arginine or lysine residue identified in the corresponding row in Column E of Table 2 may be assessed. A change in the methylation or acetylation state or level at the methylation or acetylation site, as compared to a control, indicates that the subject is suffering from, or susceptible to a form of cancer; for example, carcinoma.

In one embodiment, the methylation state or level at a methylation or acetylation site is determined by an AQUA peptide comprising the methylation or acetylation site. The AQUA peptide may be methylated or acetylated or unmethylated or unacetylated at the specified arginine or lysine position.

In another embodiment, the methylation or acetylation state or level at a methylation or acetylation site is determined by an antibody or antigen-binding fragment thereof, wherein the antibody specifically binds the methylation or acetylation site. The antibody may be one that only binds to the methylation or acetylation site when the arginine or lysine residue is methylated or acetylated, but does not bind to the same sequence when the arginine or lysine is not methylated or acetylated; or vice versa.

In particular embodiments, the antibodies of the present application are attached to labeling moieties, such as a detectable marker. One or more detectable labels can be attached to the antibodies. Exemplary labeling moieties include radiopaque dyes, radiocontrast agents, fluorescent molecules, spin-labeled molecules, enzymes, or other labeling moieties of diagnostic value, particularly in radiologic or magnetic resonance imaging techniques.

A radiolabeled antibody in accordance with this disclosure can be used for in vitro diagnostic tests. The specific activity of an antibody, binding portion thereof, probe, or ligand, depends upon the half-life, the isotopic purity of the radioactive label, and how the label is incorporated into the biological agent. In immunoassay tests, the higher the specific activity, in general, the better the sensitivity. Radioisotopes useful as labels, e.g., for use in diagnostics, include iodine ($^{131}$I or $^{125}$I), indium ($^{111}$I), technetium ($^{99}$Tc), phosphorus ($^{32}$P), carbon ($^{14}$C), and tritium ($^3$H), or one of the therapeutic isotopes listed above.

Fluorophore and chromophore labeled biological agents can be prepared from standard moieties known in the art. Since antibodies and other proteins absorb light having wavelengths up to about 310 nm, the fluorescent moieties may be selected to have substantial absorption at wavelengths above 310 nm, such as for example, above 400 nm. A variety of suitable fluorescers and chromophores are described by Stryer, Science, 162:526 (1968) and Brand et al., Annual Review of Biochemistry, 41:843-868 (1972), which are hereby incorporated by reference. The antibodies can be labeled with fluorescent chromophore groups by conventional procedures such as those disclosed in U.S. Pat. Nos. 3,940,475, 4,289,747, and 4,376,110, which are hereby incorporated by reference.

The control may be parallel samples providing a basis for comparison, for example, biological samples drawn from a healthy subject, or biological samples drawn from healthy tissues of the same subject. Alternatively, the control may be a pre-determined reference or threshold amount. If the subject is being treated with a therapeutic agent, and the progress of the treatment is monitored by detecting the arginine or lysine methylation or acetylation state level at a methylation or acetylation site of the disclosure, a control may be derived from biological samples drawn from the subject prior to, or during the course of the treatment.

In certain embodiments, antibody conjugates for diagnostic use in the present application are intended for use in vitro, where the antibody is linked to a secondary binding ligand or to an enzyme (an enzyme tag) that will generate a colored product upon contact with a chromogenic substrate. Examples of suitable enzymes include urease, alkaline phosphatase, (horseradish) hydrogen peroxidase and glucose oxidase. In certain embodiments, secondary binding ligands are biotin and avidin or streptavidin compounds.

Antibodies of the disclosure may also be optimized for use in a flow cytometry (FC) assay to determine the activation/methylation status of a target signaling protein in subjects before, during, and after treatment with a therapeutic agent targeted at inhibiting arginine or lysine methylation or acetylation at the methylation or acetylation site disclosed herein. For example, bone marrow cells or peripheral blood cells from patients may be analyzed by flow cytometry for target signaling protein methylation or acetylation, as well as for markers identifying various hematopoietic cell types. In this manner, activation status of the malignant cells may be specifically characterized. Flow cytometry may be carried out according to standard methods. See, e.g., Chow et al., *Cytometry (Communications in Clinical Cytometry)* 46: 72-78 (2001).

Alternatively, antibodies of the disclosure may be used in immunohistochemical (IHC) staining to detect differences in signal transduction or protein activity using normal and diseased tissues. IHC may be carried out according to well-known techniques. See, e.g., Antibodies: A Laboratory Manual, supra.

Peptides and antibodies of the disclosure may be also be optimized for use in other clinically-suitable applications, for example bead-based multiplex-type assays, such as IGEN, Luminex™ and/or Bioplex™ assay formats, or otherwise optimized for antibody arrays formats, such as reversed-phase array applications (see, e.g. Paweletz et al., *Oncogene* 20(16): 1981-89 (2001)). Accordingly, in another embodiment, the disclosure features a method for the multiplex detection of the methylation or acetylation state or level at two or more methylation or acetylation sites of the disclosure (Table 1 or Table 2) in a biological sample, the method comprising utilizing two or more antibodies or AQUA peptides of the disclosure. In one embodiment, two to five antibodies or AQUA peptides of the disclosure are used. In another embodiment, six to ten antibodies or AQUA peptides of the disclosure are used, while in another embodiment eleven to twenty antibodies or AQUA peptides of the disclosure are used.

In certain embodiments the diagnostic methods of the application may be used in combination with other cancer diagnostic tests.

The biological sample analyzed may be any sample that is suspected of having abnormal arginine or lysine methylation or acetylation at a methylation or acetylation site of the disclosure, such as a homogenized neoplastic tissue sample.

Screening Assays

In another aspect, the disclosure features a method for identifying an agent that modulates arginine or lysine methylation at a methylation or acetylation site of the disclosure, comprising: a) contacting a candidate agent with a peptide or protein comprising a methylation or acetylation site of the disclosure; and b) determining the methylation state or level at the methylation or acetylation site. A change in the methylation or acetylation level of the specified arginine or lysine in the presence of the test agent, as compared to a control, indicates that the candidate agent potentially modulates arginine or lysine methylation at a methylation or acetylation site of the disclosure.

In one embodiment, the acetylation level of K155 of C3 is determined to be elevated in the sera of NSCLC patients. In one aspect, the methylation level of R1593 of ARID1A is determined to be significantly lower in the sera of NSCLC than other types of cancer (eg., acute myeloid leukemia, breast cancer). In another aspect, the acetylation of K298 of albumin is determined to be elevated in in NSCLC.

In one embodiment, the methylation or acetylation state or level at a methylation or acetylation site is determined by an AQUA peptide comprising the methylation or acetylation site. The AQUA peptide may be methylated or acetylated or unmethylated or unacetylated at the specified arginine or lysine position.

In another embodiment, the methylation or acetylation state or level at a methylation or acetylation site is determined by an antibody or antigen-binding fragment thereof, wherein the antibody specifically binds the methylation or acetylation site. The antibody may be one that only binds to the methylation or acetylation site when the arginine or lysine residue is methylated or acetylated, but does not bind to the same sequence when the arginine or lysine is not methylated or not acetylated; or vice versa.

In particular embodiments, the antibodies of the present application are attached to labeling moieties, such as a detectable marker.

The control may be parallel samples providing a basis for comparison, for example, the methylation level of the target protein or peptide in absence of the testing agent. Alternatively, the control may be a pre-determined reference or threshold amount.

Immunoassays

In another aspect, the present application concerns immunoassays for binding, purifying, quantifying and otherwise generally detecting the methylation or acetylation state or level at a methylation or acetylation site of the disclosure.

Assays may be homogeneous assays or heterogeneous assays. In a homogeneous assay the immunological reaction usually involves a methylation or acetylation site-specific antibody of the disclosure, a labeled analyte, and the sample of interest. The signal arising from the label is modified, directly or indirectly, upon the binding of the antibody to the labeled analyte. Both the immunological reaction and detection of the extent thereof are carried out in a homogeneous solution. Immunochemical labels that may be used include free radicals, radioisotopes, fluorescent dyes, enzymes, bacteriophages, coenzymes, and so forth.

In a heterogeneous assay approach, the reagents are usually the specimen, a methylation or acetylation site-specific antibody of the disclosure, and suitable means for producing a detectable signal. Similar specimens as described above may be used. The antibody is generally immobilized on a support, such as a bead, plate or slide, and contacted with the specimen suspected of containing the antigen in a liquid phase. The support is then separated from the liquid phase and either the support phase or the liquid phase is examined for a detectable signal using means for producing such signal. The signal is related to the presence of the analyte in the specimen. Means for producing a detectable signal include the use of radioactive labels, fluorescent labels, enzyme labels, and so forth.

Methylation or acetylation site-specific antibodies disclosed herein may be conjugated to a solid support suitable for a diagnostic assay (e.g., beads, plates, slides or wells formed from materials such as latex or polystyrene) in accordance with known techniques, such as precipitation.

In certain embodiments, immunoassays are the various types of enzyme linked immunoadsorbent assays (ELISAs) and radioimmunoassays (RIA) known in the art. Immunohistochemical detection using tissue sections is also particularly useful. However, it will be readily appreciated that detection is not limited to such techniques, and Western blotting, dot and slot blotting, FACS analyses, and the like may also be used. The steps of various useful immunoassays have been described in the scientific literature, such as, e.g., Nakamura et al., in Enzyme Immunoassays: Heterogeneous and Homogeneous Systems, Chapter 27 (1987), incorporated herein by reference.

In general, the detection of immunocomplex formation is well known in the art and may be achieved through the application of numerous approaches. These methods are based upon the detection of radioactive, fluorescent, biological or enzymatic tags. Of course, one may find additional advantages through the use of a secondary binding ligand such as a second antibody or a biotin/avidin ligand binding arrangement, as is known in the art.

The antibody used in the detection may itself be conjugated to a detectable label, wherein one would then simply detect this label. The amount of the primary immune complexes in the composition would, thereby, be determined.

Alternatively, the first antibody that becomes bound within the primary immune complexes may be detected by means of a second binding ligand that has binding affinity for the antibody. In these cases, the second binding ligand may be linked to a detectable label. The second binding ligand is itself often an antibody, which may thus be termed a "secondary" antibody. The primary immune complexes are contacted with the labeled, secondary binding ligand, or antibody, under conditions effective and for a period of time sufficient to allow the formation of secondary immune complexes. The secondary immune complexes are washed extensively to remove any non-specifically bound labeled secondary antibodies or ligands, and the remaining label in the secondary immune complex is detected.

An enzyme linked immunoadsorbent assay (ELISA) is a type of binding assay. In one type of ELISA, methylation or acetylation site-specific antibodies disclosed herein are immobilized onto a selected surface exhibiting protein affinity, such as a well in a polystyrene microtiter plate. Then, a suspected neoplastic tissue sample is added to the wells. After binding and washing to remove non-specifically bound immune complexes, the bound target signaling protein may be detected.

In another type of ELISA, the neoplastic tissue samples are immobilized onto the well surface and then contacted with the methylation or acetylation site-specific antibodies disclosed herein. After binding and washing to remove non-specifically bound immune complexes, the bound methylation or acetylation site-specific antibodies are detected.

Irrespective of the format used, ELISAs have certain features in common, such as coating, incubating or binding, washing to remove non-specifically bound species, and detecting the bound immune complexes.

The radioimmunoassay (RIA) is an analytical technique which depends on the competition (affinity) of an antigen for antigen-binding sites on antibody molecules. Standard curves are constructed from data gathered from a series of samples each containing the same known concentration of labeled antigen, and various, but known, concentrations of unlabeled antigen. Antigens are labeled with a radioactive isotope tracer. The mixture is incubated in contact with an antibody. Then the free antigen is separated from the antibody and the antigen bound thereto. Then, by use of a suitable detector, such as a gamma or beta radiation detector, the percent of either the bound or free labeled antigen or both is determined. This procedure is repeated for a number of samples containing various known concentrations of unlabeled antigens and the results are plotted as a standard graph. The percent of bound tracer antigens is plotted as a function of the antigen concentration. Typically, as the total antigen concentration increases the relative amount of the tracer antigen bound to the antibody decreases. After the standard graph is prepared, it is thereafter used to determine the concentration of antigen in samples undergoing analysis.

In an analysis, the sample in which the concentration of antigen is to be determined is mixed with a known amount of tracer antigen. Tracer antigen is the same antigen known to be in the sample but which has been labeled with a suitable radioactive isotope. The sample with tracer is then incubated in contact with the antibody. Then it can be counted in a suitable detector which counts the free antigen remaining in the sample. The antigen bound to the antibody or immunoadsorbent may also be similarly counted. Then, from the standard curve, the concentration of antigen in the original sample is determined.

Pharmaceutical Formulations and Methods of Administration

Methods of administration of therapeutic agents, particularly peptide and antibody therapeutics, are well-known to those of skill in the art.

Peptides of the disclosure can be administered in the same manner as conventional peptide type pharmaceuticals. In some embodiments, peptides are administered parenterally, for example, intravenously, intramuscularly, intraperitoneally, or subcutaneously. When administered orally, peptides may be proteolytically hydrolyzed. Therefore, oral application may not be usually effective. However, peptides can be administered orally as a formulation wherein peptides are not easily hydrolyzed in a digestive tract, such as liposome-microcapsules. Peptides may be also administered in suppositories, sublingual tablets, or intranasal spray.

If administered parenterally, an exemplary pharmaceutical composition is an aqueous solution that, in addition to a peptide of the disclosure as an active ingredient, may contain for example, buffers such as phosphate, acetate, etc., osmotic pressure-adjusting agents such as sodium chloride, sucrose, and sorbitol, etc., antioxidative or antioxygenic agents, such as ascorbic acid or tocopherol and preservatives, such as antibiotics. The parenterally administered composition also may be a solution readily usable or in a lyophilized form which is dissolved in sterile water before administration.

The pharmaceutical formulations, dosage forms, and uses described below generally apply to antibody-based therapeutic agents, but are also useful and can be modified, where necessary, for making and using therapeutic agents of the disclosure that are not antibodies.

To achieve the desired therapeutic effect, the methylation or acetylation site-specific antibodies or antigen-binding fragments thereof can be administered in a variety of unit dosage forms. The dose will vary according to the particular antibody. For example, different antibodies may have different masses and/or affinities, and thus require different dosage levels. Antibodies prepared as Fab or other fragments will also require differing dosages than the equivalent intact immunoglobulins, as they are of considerably smaller mass than intact immunoglobulins, and thus require lower dosages to reach the same molar levels in the patient's blood. The dose will also vary depending on the manner of administration, the particular symptoms of the patient being treated, the overall health, condition, size, and age of the patient, and the judgment of the prescribing physician. Dosage levels of the antibodies for human subjects are generally between about 1 mg per kg and about 100 mg per kg per patient per treatment, such as for example, between about 5 mg per kg and about 50 mg per kg per patient per treatment. In terms of plasma concentrations, the antibody concentrations may be in the range from about 25 µg/mL to about 500 µg/mL. However, greater amounts may be required for extreme cases and smaller amounts may be sufficient for milder cases.

Administration of an antibody will generally be performed by a parenteral route, typically via injection such as intra-articular or intravascular injection (e.g., intravenous infusion) or intramuscular injection. Other routes of administration, e.g., oral (p.o.), may be used if desired and practicable for the particular antibody to be administered. An antibody can also be administered in a variety of unit dosage forms and their dosages will also vary with the size, potency, and in vivo half-life of the particular antibody being administered. Doses of a methylation or acetylation site-specific antibody will also vary depending on the manner of administration, the particular symptoms of the patient being treated, the overall health, condition, size, and age of the patient, and the judgment of the prescribing physician.

The frequency of administration may also be adjusted according to various parameters. These include the clinical response, the plasma half-life of the antibody, and the levels of the antibody in a body fluid, such as, blood, plasma, serum, or synovial fluid. To guide adjustment of the frequency of administration, levels of the antibody in the body fluid may be monitored during the course of treatment.

Formulations particularly useful for antibody-based therapeutic agents are also described in U.S. Patent App. Publication Nos. 20030202972, 20040091490 and 20050158316. In certain embodiments, the liquid formulations of the application are substantially free of surfactant and/or inorganic salts. In another specific embodiment, the liquid formulations have a pH ranging from about 5.0 to about 7.0. In yet another specific embodiment, the liquid formulations comprise histidine at a concentration ranging from about 1 mM to about 100 mM. In still another specific embodiment, the liquid formulations comprise histidine at a concentration ranging from 1 mM to 100 mM. It is also contemplated that the liquid formulations may further comprise one or more excipients such as a saccharide, an amino acid (e.g., arginine, lysine, and methionine) and a polyol. Additional descriptions and methods of preparing and analyzing liquid formulations can be found, for example, in PCT publications WO 03/106644, WO 04/066957, and WO 04/091658.

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the pharmaceutical compositions of the application.

In certain embodiments, formulations of the subject antibodies are pyrogen-free formulations which are substantially free of endotoxins and/or related pyrogenic substances. Endotoxins include toxins that are confined inside microorganisms and are released when the microorganisms are broken down or die. Pyrogenic substances also include fever-inducing, thermostable substances (glycoproteins) from the outer membrane of bacteria and other microorganisms. Both of these substances can cause fever, hypotension and shock if administered to humans. Due to the potential harmful effects, it is advantageous to remove even low amounts of endotoxins from intravenously administered pharmaceutical drug solutions. The Food & Drug Administration ("FDA") has set an upper limit of 5 endotoxin units (EU) per dose per kilogram body weight in a single one hour period for intravenous drug applications (The United States Pharmacopeial Convention, Pharmacopeial Forum 26 (1): 223 (2000)). When therapeutic proteins are administered in amounts of several hundred or thousand milligrams per kilogram body weight, as can be the case with monoclonal antibodies, it is advantageous to remove even trace amounts of endotoxin.

The amount of the formulation which will be therapeutically effective can be determined by standard clinical techniques. In addition, in vitro assays may optionally be used to help identify optimal dosage ranges. The precise dose to be used in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems. The dosage of the compositions to be administered can be determined by the skilled artisan without undue experimentation in conjunction with standard dose-response studies. Relevant circumstances to be considered in making those determinations include the condition or conditions to be treated, the choice of composition to be administered, the age, weight, and response of the individual patient, and the severity of the patient's symptoms. For example, the actual patient body weight may be used to calculate the dose of the formulations in milliliters (mL) to be administered. There may be no downward adjustment to "ideal" weight. In such a situation, an appropriate dose may be calculated by the following formula:

Dose (mL)=[patient weight (kg)×dose level (mg/kg)/drug concentration (mg/mL)]

For the purpose of treatment of disease, the appropriate dosage of the compounds (for example, antibodies) will depend on the severity and course of disease, the patient's clinical history and response, the toxicity of the antibodies, and the discretion of the attending physician. The initial candidate dosage may be administered to a patient. The proper dosage and treatment regimen can be established by monitoring the progress of therapy using conventional techniques known to those of skill in the art.

The formulations of the application can be distributed as articles of manufacture comprising packaging material and a pharmaceutical agent which comprises, e.g., the antibody and a pharmaceutically acceptable carrier as appropriate to the mode of administration. The packaging material will include a label which indicates that the formulation is for use in the treatment of prostate cancer.

Kits

Antibodies and peptides (including AQUA peptides) of the disclosure may also be used within a kit for detecting the methylation or acetylation state or level at a methylation or acetylation site of the disclosure, comprising at least one of the following: an AQUA peptide comprising the methylation or acetylation site, or an antibody or an antigen-binding fragment thereof that binds to an amino acid sequence comprising the methylation or acetylation site. Such a kit may further comprise a packaged combination of reagents in predetermined amounts with instructions for performing the diagnostic assay. Where the antibody is labeled with an enzyme, the kit will include substrates and co-factors required by the enzyme. In addition, other additives may be included such as stabilizers, buffers and the like. The relative amounts of the various reagents may be varied widely to provide for concentrations in solution of the reagents that substantially optimize the sensitivity of the assay. Particularly, the reagents may be provided as dry powders, usually lyophilized, including excipients that, on dissolution, will provide a reagent solution having the appropriate concentration.

The following Examples are provided only to further illustrate the disclosure, and are not intended to limit its scope, except as provided in the claims appended hereto. The disclosure encompasses modifications and variations of the methods taught herein which would be obvious to one of ordinary skill in the art.

EXAMPLES

Example 1

Identification of Methylation Sites in HCT116 Cells

Protein methylation site identification using methyl-motif antibodies to enrich methylated peptides and analysis of the enriched peptides by LC-MS/MS was developed Tryptic peptides from approximately 10 mg of protein extract derived from either cell lines or tissue samples, and 100-250 µg of methylation specific antibodies.

From a single experiment using Me-R4-100 (Cell Signaling Technology, #8015) antibody to immunoprecipitate tryptic peptides from HCT116 cells, 1106 MMA sites from 1743 unique methylated peptides from 570 proteins were identified. The R*GG (D5A12) (CST #8711) antibody identified 942 MMA sites from 1456 unique monomethyl arginine peptides from 489 proteins. With a ADMA-specific monoclonal antibody (D4H5), 226 ADMA sites from 287 unique peptides from 97 proteins were identified. Using a different ADMA-specific monoclonal antibody (D6A8) with HCT116 tryptic peptides, 335 ADMA sites were identified from 440 peptides from 140 proteins. HCT116 tryptic peptides were used in lysine methylation profiling experiments with polyclonal anti-methyl lysine antibodies against monomethyl-lysine (Kme1), dimethyl-lysine (Kme2), and trimethyl-lysine (Kme3). Kme1 antibody identified 132 mono methyl lysine sites from 111 proteins; Kme2 and Kme3 identified 35 and 31 sites, respectively, from about 20 proteins were identified.

Example 2

Protein Lysine Methylation Sites Identified in HCT116 Cells

Using Kme1, Kme2, and Kme3 antibodies in HCT116 cells, in total 165 lysine methylation sites were identified: 132 monomethyl K, 35 dimethyl K, and 31 trimethyl K. There were far fewer lysine methylation sites than arginine methylation sites. Western blot analysis with lysine methylation antibodies showed fewer bands than arginine methylation blots, which reflect that there are fewer lysine methylation sites in the cells. To rule out the possibility that fewer lysine methylation site identifications was due to antibody affinity/specificity issues, a diverse population of dimethylated peptides were generated by reductive amination reaction (Hsu, J. L., et. al., (2003) Stable-isotope dimethyl labeling for quantitative proteomics. *Analytical Chemistry* 75, 6843-6852), and a mix of dimethyl peptides and unlabeled peptides from HCT116 cells at a ratio of 1:9 (1 mg labeled: 9 mg unlabeled) were used to do immunoaffinity enrichment using dimethyl lysine antibody. From this experiment, 3857 dimethylated lysine peptides corresponding to 2763 unique sites were identified. The fact that the antibody selectively enriched a diverse population of dimethylated sequences suggests that the small set of peptides identified in vivo from the HCT116 cells is not due to antibody affinity/specificity.

In the lysine methylation site profiling experiments using tryptic peptides from HCT116 cells, several lysine methylation sites were identified, including components of the transcription complex such as transcription factors POLR2B, POLR3B. Also identified were lysine methylation on several lysine methyl transferases including dimethylation of EZH2, mono-, di-, and tri-methylation of SETDB1, and mono-methylation of EZH1 (Table 1).

Example 3

Profiling Arginine Methylation of Mouse Brain and Mouse Embryo

Protein arginine methylation in mouse brain (from 3 month old mice) and mouse embryo (E16-17) were profiled by immunoaffinity enrichment using various arginine methylation antibodies and LC-MS/MS analysis. In total, 807 MMA sites on 453 proteins from mouse brain and 598 MMA sites on 331 proteins from mouse embryo using a combination of D5A12 and Me-R4-1000 antibodies we identified, corresponding to a total of 1070 unique MMA sites from two tissues. Asymmetric dimethylated peptides were enriched with D4H5 and D6A8 antibodies or the combination of the two, and 697 ADMA sites on 321 proteins were identified. MS/MS spectra of many proteins known to be brain-specific were identified in the brain samples but not in embryo as expected.

To demonstrate a quantitative assessment of the IAP-LC-MS/MS method for identifying and quantifying methyl proteins among samples, the technical variation of immunoprecipitation using monomethyl arginine antibodies were evaluated in three independent IAPB. The experiments were performed using the same batch of mouse embryo peptides with mixture of the two MMA antibodies Me-R4-100 and D5A12. Each sample was processed separately and the resulting enriched methylated peptides were analyzed by LC-MS/MS in duplicate runs. In total, 818 unique arginine monomethylation peptides were identified, among which, over 66% of the sites were identified in common from three IAPB. Each site was quantified by label-free techniques using Skyline software. The median variation (% CV, percent coefficient of variation) between replicate injections of matched methylated peptides for the three independent IAP samples were of 14%, 13% and 9% respectively. The variation associated with the IAP method was illustrated from the median % CV across three independent IAPB for the mouse embryo samples, and was determined to be 13. In addition, 80% of the methylation sites that were quantified had % CVs lower than 20%. The results from this experiment demonstrates that the IAP-LC-MS/MS method is quantitatively reproducible when experiments are performed in parallel, and the LC-MS/MS analysis is collected in the same period of time.

To have a better understanding of the abundance of arginine-methylated proteins in different tissues, the data from the MMA profiling of mouse brain and mouse embryo in biological were analyzed in triplicate experiments using Skyline software to compare the relative abundance of common methylation sites between the two tissues. In these experiments, a total of 10 mg of peptides from either mouse brain or mouse embryo were used in each IAP experiment using the same amount of MMA antibodies, the IAPB were done in parallel at the same time, each IAP sample was analyzed in duplicate LC-MS/MS runs. In total, there were 6 datasets from mouse brain and 6 datasets from mouse embryo. MS1 precursor intensities of methylated peptides were compared between corresponding MS runs from mouse brain versus mouse embryo and averaged for each tissues to obtain the relative abundance of common methylation sites, which provided confident quantitative results of over 1000 unique arginine monomethylation sites from the tissues. An arbitrary fold change threshold of 5 was set as a quantitative cut-off to indicate whether a particular methylation peptide was more abundant in one tissue than the other. From this analysis, there were in total 480 and 272 unique monomethylation peptides with high abundance in mouse brain and embryo respectively, including 31 and 12 monomethylation peptides that existed in brain and embryo only, respectively. A scatter plot of log 2 intensity ratio of Brain/Embryo of each methylation site vs. total peptide intensity was made to represent the peptides that are specific or rich in one particular mouse tissue. For statistic analysis, the p-value was provided for each ratio by t-test. Due to the biological variation of mouse brain, many monomethylation peptides that were abundant in brain were associated with high p-value. The IAP experiment results are consistent with western blot analysis of the lysates from the two tissues. The patterns of arginine methylation from the two tissues indicate that arginine methylation does vary in both directions for distinct protein bands.

Protein immunoprecipitation of mouse brain and embryo lysates was performed using a mix of D5A12 and Me-R4-100 MMA antibodies, followed by western blot analysis using protein specific antibodies to confirm the results. PABP1 was more abundant in mouse embryo, and correspondingly methylated PABP1 was also more abundant in mouse embryo. SNIP showed similar abundance in mouse brain and mouse embryo, but was only methylated in mouse brain. This indicates some of the tissue specific methylation observed was due to different protein expression in different tissues, but some other tissue specific methylation is due to the different level of the methylation on the relatively equally expressed proteins. Other types of validation studies such as western blot analysis or total proteome profiling can be performed for important sites that have been identified by IAP-MS experiments.

Additional experimental detail may be found in Guo et al., 2014, Mol. Cell. Proteomics, 13:372-387, which is incorporated herein by reference in its entirety.

Example 4

Identification of Methylation and Acetylation Sites in Human Serum

Serum of Cancer Patients—

Serum samples of 4 patients of AML, BC and NSCLC were purchased from Proteogenex (Culver City, Calif.), respectively.

Tryptic Digestion of Serum—

Equal volume of serum (50 μL for pooled sample and 250 μLL for individual sample) was mixed with urea lysis buffer (9M sequanol grade Urea, 20 mM HEPES pH 8.0, 1 mM b-glycerophosphate, 1 mM sodium vanadate, 2.5 mM sodium pyrophosphate) at the ratio of 1:2 to get the final concentration of urea of 6M. The mixture was centrifuged at 16,000×g for 15 min at 4° C. Supernatants were collected and reduced with 4.5 mM DTT for 30 min at 55° C. Reduced lysates were alkylated with iodoacetimide (0.095 g per 5 mL $H_2O$) for 15 min at room temperature in the dark. Samples were diluted 1:3 with 20 mM HEPES pH 8.0 and digested overnight with 10 ug/mL trypsin-TPCK (Worthington, #LS003740). Digested peptide lysates were acidified with 1% TFA and peptides were desalted over 360 mg SEP PAK Classic C18 columns (Waters, #WAT051910). Peptides were eluted with 40% acetonitrile in 0.1% TFA, dried under vacuum, and stored at −80° C.

Immunoprecipitation—

Enrichment of post-translational modified peptides were done using corresponding PTMScan motif antibodies following the protocols described previously. Briefly, saturating amounts of the indicated antibodies were bound to 25-30 mL packed Protein A agarose beads (Roche) overnight at 4° C. Lyophilized serum peptides were resuspended in MOPS IAP buffer (50 mM MOPS pH 7.2, 10 mM $KH_2PO_4$, 50 mM NaCl) and centrifuged 5 min at 12,000 rpm in a MiniSpin microcentrifuge (Eppendorf). Supernatants were mixed with PTMScan Reagent-Bead slurries 2 hours at 4° C. Beads were pelleted by centrifugation 30 seconds at 5,400 rpm in a MiniSpin microcentrifuge at 4° C. Beads were washed three times with 1.5 mL IAP buffer containing 1% NP-40 and three times with 1 mL water (Burdick and Jackson). Peptides were eluted from beads with 0.15% TFA (sequential elutions of 40 mL followed by 35 mL, 10 min each at room temperature). Eluted peptides were desalted over tips packed with Empore C18 (Sigma) and eluted with 40% acetonitrile in 0.1% TFA. Eluted peptides were dried under vacuum and subject to a second, in-solution trypsin digest using 250 ng of sequencing grade trypsin (Promega) in 50 mM ammonium bicarbonate/5% acetonitrile for 2 hours at 37° C. Samples were acidified with TFA and re-purified over C18 tips as before.

Imac—

IMAC enrichment was performed as previously described. Nickel-agarose beads (Invitrogen) were treated with EDTA to remove the Nickel, washed 3× with $H_2O$, loaded with aqueous $FeCl_3$ for 30 min, and washed. For phosphopeptide enrichment 10 ml $Fe^{3+}$-agarose slurry was added to peptide digested from 10 ml of serum in 1 mL 0.1% TFA/80% acetonitrile for 30 min at room temperature. Unbound peptides were removed by washing 3× with 0.1% TFA/80% MeCN. Bound peptides were eluted with 2×50 mL of 2.5% ammonia/50% acetonitrile solution for 5 min. The pH of the eluent was immediately adjusted to acidic by 20% TFA and dried in a speed-vac. Samples were resuspended in 50 mL 0.15% TFA, desalted over C-18 and dried as previously described.

LC-MS/MS Analysis—

Immunoprecipitated peptides were resuspended in 0.125% formic acid and separated on a reversed-phase $C_{18}$ column (75 mm ID×10 cm) packed into a PicoTip emitter (~8 mm ID) with Magic $C_{18}$ AQ (100 Å×5 mm). Each sample was split and analytical replicate injections were run to increase the number of identifications and provide metrics for analytical reproducibility of the method. For antibody enrichment peptides from ~120 mL serum were run per injection, for IMAC peptides from ~5 mL serum were run per injection. Replicate injections were run non-sequentially to reduce artificial changes in peptide abundance due to changes in instrument performance over time. One replicate of each sample was injected, then the second replicate in reverse order. Peptides were eluted using a 120-minute or 150-minute linear gradient of acetonitrile in 0.125% formic acid delivered at 280 nL/min. Tandem mass spectra were collected in a data-dependent manner with an LTQ-Orbitrap ELITE mass spectrometer running XCalibur 2.0.7 SP1 using a top-twenty MS/MS method, a dynamic repeat count of one, and a repeat duration of 30 sec. Real time recalibration of mass error was performed using lock mass with a singly charged polysiloxane ion m/z=371.101237. The data associated with this manuscript may be downloaded from PRIDE using the following link:

MS/MS spectra were evaluated using SEQUEST and the Core platform from Harvard University. Files were searched against the NCBI *Homo sapiens* FASTA database updated on Jun. 27, 2011 containing 34,899 forward and 34,899 reverse sequences. A mass accuracy of +/−50 ppm was used for precursor ions and 1 Da for product ions. Enzyme specificity was limited to trypsin, with at least one tryptic (K- or R-containing) terminus required per peptide and up to four mis-cleavages allowed. Cysteine carboxamidomethylation was specified as a static modification, oxidation of methionine residues was allowed, and corresponding PTM was allowed for each enrichment sample set. Reverse decoy databases were included for all searches to estimate false discovery rates, and filtered using a 1% FDR in the Linear Discriminant module of Core. Results were further narrowed by mass accuracy based on clustering of forward and reverse assignments in Xcorr versus mass error plots. Typically forward database assignments cluster within −/+5 ppm of calculated m/z, so results were limited to peptides that fall within that range. A larger mass error range (−/+50 ppm) was used for the searches to allow for identification even if the lock mass signal was not adequate for accurate mass calibration. Peptides were also manually filtered using reagent-specific criteria.

All quantitative results were generated using Progenesis V4.1 (Waters Cooperation) and Skyline Version 3.1 to extract the integrated peak area of the corresponding peptide assignments according to previously published protocols. Extracted ion chromatograms for peptide ions that changed in abundance between samples were manually reviewed to ensure accurate quantitation in Skyline. Statistical analysis of the quantitative data was done using two-tail t-test between two cancer groups in Excel. And the max negative log-p value from three comparison pairs was used to indicate whether there existed significant abundance change of a certain PTM site between two cancer groups. Heat map of the quantitative data was generated and clustered in Spotfire DecisionSite (TIBCO Software AB) version 9.1.2.

Western Blotting—

Equal volume of serum samples were mixed with SDS-PAGE sample buffer (Cell Signaling Technology, Inc., #7723,) and run on 4-20% gradient Tris-glycine gels (Invitrogen). For pan-AcK and pan-Rme western blots, serum was diluted 10 fold and 20 µL was loaded. For For albumin, serum was diluted by 10,000 fold and 20 µL was loaded; while for FETUA, serum was diluted 200 fold and 20 µL was loaded. Proteins were transferred to nitrocellulose (Millipore) and blocked for 1 hour in 5% nonfat dry milk (Sigma) in TBS. Motif antibody for pan-AcK (#13420) and pan-Rme (#8015, 8711), primary antibodies for albumin (#4929) were incubated in 5% BSA in TBS plus 0.1% Tween-20 (TBS-T) overnight at 4° C. Membranes were washed 3 times with TBS-T, incubated with anti-rabbit secondary antibody (#5366, Cell Signaling Technology) for 1 hour at room temperature in 5% milk TBS-T, washed 3 times with TBS-T, dried, and developed on the Odyssey near-infrared imaging system (LI-COR). All antibodies were from Cell Signaling Technology, Inc.

Among the PTMs surveyed, lysine acetylation and arginine mono-methylation were identified as the most abundant types of PTM in cancer patients' sera. At 1% FDR, 796 unique AcK sites in the sera of 12 cancer patients were identified (see Table 2), of which, 612 AcK sites were successfully quantified based on the criteria of the chromatographic shapes and the signals of their extracted ion chromatograms of precursor ions; by the same criteria, 808 unique Rme sites were identified (see Table 1), and 621 sites were quantified.

For AcK sites, the top five protein categories are secreted protein, receptor/channel/transporter/cell surface protein, adhesion/extracellular protein, chromatin/DNA-binding/DNA repair/DNA replication protein and transcriptional regulator. Albumin was identified as one of the most heavily acetylated protein with a total number of 76 unique AcK sites. Heavy acetylation was observed on other serum abundant proteins as well including alpha-2-macroglobulin and serotransferrin with a total number of 35 and 29 unique AcK sites identified, respectively. Actually, a decent fraction of the unique AcK sites (190 out of 796) were identified in top 12 abundant serum proteins. For Rme sites, we identified only 4 out of 808 unique Rme sites from top 12 abundant serum proteins. Therefore, the top five protein categories for Rme are receptor/channel/transporter/cell surface protein, RNA processing, transcriptional regulator, adhesion/extracellular protein and adaptor/scaffold. We identified a large number unique Rme sites in various heterogeneous nuclear ribonucleoproteins isoforms, and most of which were identified before. However, the existence of the sites in serum/plasma was not reported by any of the previous studies. There were only 35 proteins identified in common between the results of AcK and Rme enrichment. We also compared our results with a recent large-scale plasma proteome study using iTRAQ labeling and offline fractionation prior to LC-MS/MS analysis, which identified over 5300 proteins with high confidence. There was a medium to small fraction of proteins, 206 out of 569 for AcK, and 205 out of 799 for Rme that were identified in the large-scale study.

The average intensity of acetylation of K155 of C3 showed 8.1 and 4.4 fold increases in NSCLC than AML and BC; while 5.4 and 4.3 fold decreases of arginine methylation level of R1593 of ARID1A were observed in NSCLC comparing to AML and BC. Both sites were represented by peptides with good quality MS/MS spectra. Inconsistent patter of intensity of AcK of patient #4 of NSCLC compared to patients #1, #2 and #3 was exampled by several sites of acetylation of albumin. While the average intensity of acetylation of K298 of albumin in NSCLC patients #1, #2 and #3 showed 9.7 and 2.9 fold increases as compared to those in AML and BC; the site had comparable intensity in patient #4 of NSCLC with those in AML and BC. Although there were intensity changes observed at several AcK sites of albumin, the overall protein level of albumin was not changed. It is worth noting that histological diagnosis of #4 NSCLC patient (with 35 years of smoking history) was squamous cell carcinoma; while the histological diagnosis of #1, #2 and #3 patients (non-smokers) of NSCLC was adenocarcinoma.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (5487 sequences)

SEQ ID NO: 1 - protein, 13 aa, Artificial Sequence
  Synthetic Peptide
WSPRRLRGGPQCL

SEQ ID NO: 2 - protein, 13 aa, Artificial Sequence
  Synthetic Peptide
SLDGFLRGRGQGR

SEQ ID NO: 3 - protein, 13 aa, Artificial Sequence
  Synthetic Peptide
LNYMGGRGLGGPS

SEQ ID NO: 4 - protein, 13 aa, Artificial Sequence
  Synthetic Peptide
MPYGCGRSQTRIR

SEQ ID NO: 5 - protein, 13 aa, Artificial Sequence
  Synthetic Peptide
LSKEGGRGGISSG

SEQ ID NO: 6 - protein, 13 aa, Artificial Sequence
  Synthetic Peptide
PLGSLSRSSLDAT

SEQ ID NO: 7 - protein, 13 aa, Artificial Sequence
  Synthetic Peptide
AFSTEPRFCAPRA

SEQ ID NO: 8 - protein, 13 aa, Artificial Sequence
  Synthetic Peptide
DTNYVKRGSWSTL

SEQ ID NO: 9 - protein, 13 aa, Artificial Sequence
  Synthetic Peptide
STLQFPRGEAKAR

SEQ ID NO: 10 - protein, 13 aa, Artificial Sequence
  Synthetic Peptide
  misc_feature (9)..(13): Xaa can be any naturally occurring amino acid
RGITTPRQXXXXX

SEQ ID NO: 11 - protein, 13 aa, Artificial Sequence
  Synthetic Peptide
RRDNRLRGPGGPR

SEQ ID NO: 12 - protein, 13 aa, Artificial Sequence
  Synthetic Peptide
GPSGGMRGPPRGG

SEQ ID NO: 13 - protein, 13 aa, Artificial Sequence
  Synthetic Peptide
AAPGSARGGARRA

SEQ ID NO: 14 - protein, 13 aa, Artificial Sequence
  Synthetic Peptide
SARGGARRAKGDT

SEQ ID NO: 15 - protein, 13 aa, Artificial Sequence
  Synthetic Peptide
RGTTVTRGALPVP

SEQ ID NO: 16 - protein, 13 aa, Artificial Sequence
  Synthetic Peptide
PVPPIARGVPTPR

SEQ ID NO: 17 - protein, 13 aa, Artificial Sequence
  Synthetic Peptide
GRGSPLREVSRSL

SEQ ID NO: 18 - protein, 13 aa, Artificial Sequence
  Synthetic Peptide
IYGPGPRGYNNQP

SEQ ID NO: 19 - protein, 13 aa, Artificial Sequence
  Synthetic Peptide
ISIVGGRGMGSRL

SEQ ID NO: 20 - protein, 13 aa, Artificial Sequence
  Synthetic Peptide
QLGFNIRGGKASQ

SEQ ID NO: 21 - protein, 13 aa, Artificial Sequence
  Synthetic Peptide
YGAGSGRAGKRGR

SEQ ID NO: 22 - protein, 13 aa, Artificial Sequence
  Synthetic Peptide
MTRQASRESTDGS

SEQ ID NO: 23 - protein, 13 aa, Artificial Sequence
  Synthetic Peptide
DPAGVGRGGGAAG

SEQ ID NO: 24 - protein, 13 aa, Artificial Sequence
  Synthetic Peptide
ERLRLSRGGGTLK

SEQ ID NO: 25 - protein, 13 aa, Artificial Sequence
  Synthetic Peptide
TATDSLRGVRRNS

SEQ ID NO: 26 - protein, 13 aa, Artificial Sequence
  Synthetic Peptide
KVSPAPRPSSLPI

SEQ ID NO: 27 - protein, 13 aa, Artificial Sequence
  Synthetic Peptide
PGLFDIRSSPTGG

SEQ ID NO: 28 - protein, 13 aa, Artificial Sequence
  Synthetic Peptide
GGSLGSRGRRRKL

SEQ ID NO: 29 - protein, 13 aa, Artificial Sequence
  Synthetic Peptide
ALSGASRSLSPTR

SEQ ID NO: 30 - protein, 13 aa, Artificial Sequence
  Synthetic Peptide
AQAPALRYFQLPP

SEQ ID NO: 31 - protein, 13 aa, Artificial Sequence
  Synthetic Peptide
RRELGYRAGLGSQ

SEQ ID NO: 32 - protein, 13 aa, Artificial Sequence
  Synthetic Peptide
YFQLPPRAASAAM

SEQ ID NO: 33 - protein, 13 aa, Artificial Sequence
  Synthetic Peptide
AMYVPARSGRGRK

SEQ ID NO: 34 - protein, 13 aa, Artificial Sequence
  Synthetic Peptide
GALPWARGGSGGS

SEQ ID NO: 35 - protein, 13 aa, Artificial Sequence
  Synthetic Peptide
PSLRGWRGGGPSP

SEQ ID NO: 36 - protein, 13 aa, Artificial Sequence
  Synthetic Peptide
PQGTRGRGSGAPG

SEQ ID NO: 37 - protein, 13 aa, Artificial Sequence
  Synthetic Peptide
RLTPSPRGGPFNP

SEQ ID NO: 38 - protein, 13 aa, Artificial Sequence
  Synthetic Peptide
RHEPVLRLWGDPA

SEQ ID NO: 39 - protein, 13 aa, Artificial Sequence
  Synthetic Peptide
SGPSAGRGGHNKI

SEQ ID NO: 40 - protein, 13 aa, Artificial Sequence
  Synthetic Peptide
  misc_feature (8)..(13): Xaa can be any naturally occurring amino acid
QPGPGYRXXXXXX

SEQ ID NO: 41 - protein, 13 aa, Artificial Sequence
  Synthetic Peptide
IPAGGGRGGGHEP

SEQ ID NO: 42 - protein, 13 aa, Artificial Sequence
  Synthetic Peptide
HFPLTGRGEVWGA

SEQ ID NO: 43 - protein, 13 aa, Artificial Sequence
  Synthetic Peptide
SLTQTFRAREQLA

SEQ ID NO: 44 - protein, 13 aa, Artificial Sequence
  Synthetic Peptide
TQTFRAREQLAAV

SEQ ID NO: 45 - protein, 13 aa, Artificial Sequence
  Synthetic Peptide
GPPPPGRGGPPPP

SEQ ID NO: 46 - protein, 13 aa, Artificial Sequence
  Synthetic Peptide
PEHGPDRGPFRGG

SEQ ID NO: 47 - protein, 13 aa, Artificial Sequence
  Synthetic Peptide
RFGHRLREFEGRG

SEQ ID NO: 48 - protein, 13 aa, Artificial Sequence
  Synthetic Peptide
LREFEGRGGPLPQ

SEQ ID NO: 49 - protein, 13 aa, Artificial Sequence
  Synthetic Peptide
DRGSKGRGGPGPS

SEQ ID NO: 50 - protein, 13 aa, Artificial Sequence
  Synthetic Peptide
DEAARGRDLRGRG

SEQ ID NO: 51 - protein, 13 aa, Artificial Sequence
  Synthetic Peptide
ASDEAARGRDLRG

SEQ ID NO: 52 - protein, 13 aa, Artificial Sequence
  Synthetic Peptide
AREPPSRGAAPPP

SEQ ID NO: 53 - protein, 13 aa, Artificial Sequence
  Synthetic Peptide
KTNRAARGAPPLP

SEQ ID NO: 54 - protein, 13 aa, Artificial Sequence
  Synthetic Peptide
KTPGPVRGLAPPP

SEQ ID NO: 55 - protein, 13 aa, Artificial Sequence
  Synthetic Peptide
PSLLSNRPPPPAR

SEQ ID NO: 56 - protein, 13 aa, Artificial Sequence
  Synthetic Peptide
TAGPVGRPGQMGL

SEQ ID NO: 57 - protein, 13 aa, Artificial Sequence
  Synthetic Peptide
VGTPGQRGRLGKK

SEQ ID NO: 58 - protein, 13 aa, Artificial Sequence
  Synthetic Peptide
SRGKPGRKGYMGE

SEQ ID NO: 59 - protein, 13 aa, Artificial Sequence
  Synthetic Peptide
VAPPGGRANITSL

SEQ ID NO: 60 - protein, 13 aa, Artificial Sequence
  Synthetic Peptide
IDDNIPRRTTQRI

SEQ ID NO: 61 - protein, 13 aa, Artificial Sequence
  Synthetic Peptide
MSAPGSRSGSRSG

SEQ ID NO: 62 - protein, 13 aa, Artificial Sequence
  Synthetic Peptide
SRSGSRRGSFDAT

SEQ ID NO: 63 - protein, 13 aa, Artificial Sequence
  Synthetic Peptide
LVVTANRGSSPQV

SEQ ID NO: 64 - protein, 13 aa, Artificial Sequence
  Synthetic Peptide
FSPSSPRGGARRR

SEQ ID NO: 65 - protein, 13 aa, Artificial Sequence
  Synthetic Peptide
YGRATYRGGLEGQ

SEQ ID NO: 66 - protein, 13 aa, Artificial Sequence
  Synthetic Peptide
PSSQATRGPQPGR

SEQ ID NO: 67 - protein, 13 aa, Artificial Sequence
  Synthetic Peptide
SMSVTGRGGPRPV

SEQ ID NO: 68 - protein, 13 aa, Artificial Sequence
  Synthetic Peptide
TYPTWKRARIFPM

SEQ ID NO: 69 - protein, 13 aa, Artificial Sequence
  Synthetic Peptide
QSSHRSRGGTGSV

SEQ ID NO: 70 - protein, 13 aa, Artificial Sequence
  Synthetic Peptide
PSVTDSRPLNPSA

SEQ ID NO: 71 - protein, 13 aa, Artificial Sequence
  Synthetic Peptide
STLPAQRAASPYS

SEQ ID NO: 72 - protein, 13 aa, Artificial Sequence
  Synthetic Peptide
SSSMSSRGSGSRQ

SEQ ID NO: 73 - protein, 13 aa, Artificial Sequence
  Synthetic Peptide
SPAPRGRGGPCSP

SEQ ID NO: 74 - protein, 13 aa, Artificial Sequence
  Synthetic Peptide
VFGGAGRGLYGID

SEQ ID NO: 75 - protein, 13 aa, Artificial Sequence
  Synthetic Peptide
AYAAHGRGALAEA

SEQ ID NO: 76 - protein, 13 aa, Artificial Sequence
  Synthetic Peptide
RSQSPLRGGMTEA

SEQ ID NO: 77 - protein, 13 aa, Artificial Sequence
  Synthetic Peptide
WEPRPLRAASPFR

SEQ ID NO: 78 - protein, 13 aa, Artificial Sequence
  Synthetic Peptide
PFRSPVRGASSRE

SEQ ID NO: 79 - protein, 13 aa, Artificial Sequence
  Synthetic Peptide
PVSWRGRGGAPAE

SEQ ID NO: 80 - protein, 13 aa, Artificial Sequence
  Synthetic Peptide
QKLFNKRGGGAAS

SEQ ID NO: 81 - protein, 13 aa, Artificial Sequence
  Synthetic Peptide
PSASLGRGGGGSA

SEQ ID NO: 82 - protein, 13 aa, Artificial Sequence
  Synthetic Peptide
PEGGSGRGRRVER

SEQ ID NO: 83 - protein, 13 aa, Artificial Sequence
  Synthetic Peptide
RRTLAFRGGGGGG

SEQ ID NO: 84 - protein, 13 aa, Artificial Sequence
  Synthetic Peptide
YALYGQRLASASA

SEQ ID NO: 85 - protein, 13 aa, Artificial Sequence
  Synthetic Peptide
AASCWGRAMAGRL

SEQ ID NO: 86 - protein, 13 aa, Artificial Sequence
  Synthetic Peptide
GTAPAGRGFRRAS

SEQ ID NO: 87 - protein, 13 aa, Artificial Sequence
  Synthetic Peptide
GDYYVPRGGRRRF

SEQ ID NO: 88 - protein, 13 aa, Artificial Sequence
  Synthetic Peptide
RSRSRTRAGAGGG

SEQ ID NO: 89 - protein, 13 aa, Artificial Sequence
  Synthetic Peptide
TSSTHHRGGHGVP

SEQ ID NO: 90 - protein, 13 aa, Artificial Sequence
  Synthetic Peptide
STPSDSRGRSRAK

SEQ ID NO: 91 - protein, 13 aa, Artificial Sequence
  Synthetic Peptide
HQSNQARGAGVPP

SEQ ID NO: 92 - protein, 13 aa, Artificial Sequence
  Synthetic Peptide
EKEGKGRTASPVN

SEQ ID NO: 93 - protein, 13 aa, Artificial Sequence
  Synthetic Peptide
PVNSPARGTPSPK

SEQ ID NO: 94 - protein, 13 aa, Artificial Sequence
  Synthetic Peptide
VEGVFGRGGGREM

SEQ ID NO: 95 - protein, 13 aa, Artificial Sequence
  Synthetic Peptide
SGPASGRGTKNRD

SEQ ID NO: 96 - protein, 13 aa, Artificial Sequence
  Synthetic Peptide
QVTYNCRAPQSGT

SEQ ID NO: 97 - protein, 13 aa, Artificial Sequence
  Synthetic Peptide
IQNQYLRMSLPNM

SEQ ID NO: 98 - protein, 13 aa, Artificial Sequence
  Synthetic Peptide
RIYHPVRYYYIQN

SEQ ID NO: 99 - protein, 13 aa, Artificial Sequence
  Synthetic Peptide
DLKAKQRAEVLQS

SEQ ID NO: 100 - protein, 13 aa, Artificial Sequence
  Synthetic Peptide
VLQSTQRFFSEQQ

SEQ ID NO: 101 - protein, 13 aa, Artificial Sequence
  Synthetic Peptide
GSLSGVRGNQAQA

SEQ ID NO: 102 - protein, 13 aa, Artificial Sequence
  Synthetic Peptide
FPDQGYRGRGRGE

SEQ ID NO: 103 - protein, 13 aa, Artificial Sequence
  Synthetic Peptide
NKSLRGRGPPPSW

SEQ ID NO: 104 - protein, 13 aa, Artificial Sequence
  Synthetic Peptide
EANKSLRGRGPPP

SEQ ID NO: 105 - protein, 13 aa, Artificial Sequence
  Synthetic Peptide
DQGYRGRGRGEYY

SEQ ID NO: 106 - protein, 13 aa, Artificial Sequence
  Synthetic Peptide
DRASPSRQSFKKE

SEQ ID NO: 107 - protein, 13 aa, Artificial Sequence
  Synthetic Peptide
GGAGGARGGAGGG

SEQ ID NO: 108 - protein, 13 aa, Artificial Sequence
  Synthetic Peptide
AAGLPLRPFPTAG

SEQ ID NO: 109 - protein, 13 aa, Artificial Sequence
  Synthetic Peptide
VPQQGLRLQPAKA

SEQ ID NO: 110 - protein, 13 aa, Artificial Sequence
  Synthetic Peptide
PAPSAGRGRGQAR

SEQ ID NO: 111 - protein, 13 aa, Artificial Sequence
  Synthetic Peptide
PRGNRSRGAGSFF

SEQ ID NO: 112 - protein, 13 aa, Artificial Sequence
  Synthetic Peptide
DFFGNRRGPRGNR

SEQ ID NO: 113 - protein, 13 aa, Artificial Sequence
  Synthetic Peptide
NDFDLARADFQKV

SEQ ID NO: 114 - protein, 13 aa, Artificial Sequence
  Synthetic Peptide
VPFSLLRSPSWEP

SEQ ID NO: 115 - protein, 13 aa, Artificial Sequence
  Synthetic Peptide
TGGFGGRGGGHAA

SEQ ID NO: 116 - protein, 13 aa, Artificial Sequence
  Synthetic Peptide
QPPPLQRAPPPTV

SEQ ID NO: 117 - protein, 13 aa, Artificial Sequence
  Synthetic Peptide
APPPTVRSKNPGP

SEQ ID NO: 118 - protein, 13 aa, Artificial Sequence
  Synthetic Peptide
ACYNCGRGGHIAK

SEQ ID NO: 119 - protein, 13 aa, Artificial Sequence
  Synthetic Peptide
GTPLAVRALTPVS

SEQ ID NO: 120 - protein, 13 aa, Artificial Sequence
  Synthetic Peptide
DPNAPKRPPSGFF

SEQ ID NO: 121 - protein, 13 aa, Artificial Sequence
  Synthetic Peptide
GIPPAPRGVPQIE

SEQ ID NO: 122 - protein, 13 aa, Artificial Sequence
  Synthetic Peptide
GRGHSARSRGRPK

SEQ ID NO: 123 - protein, 13 aa, Artificial Sequence
  Synthetic Peptide
ANGFKIRLTPGVS

SEQ ID NO: 124 - protein, 13 aa, Artificial Sequence
  Synthetic Peptide
GFQPAPRGGGGGG

SEQ ID NO: 125 - protein, 13 aa, Artificial Sequence
  Synthetic Peptide
DKLYERRGGGSGG

SEQ ID NO: 126 - protein, 13 aa, Artificial Sequence
  Synthetic Peptide
IRQTVNRGGGGFG

SEQ ID NO: 127 - protein, 13 aa, Artificial Sequence
  Synthetic Peptide
AFPGALRGSPPFE

SEQ ID NO: 128 - protein, 13 aa, Artificial Sequence
  Synthetic Peptide
STPLGPRLLFGSG

SEQ ID NO: 129 - protein, 13 aa, Artificial Sequence
  Synthetic Peptide
ELRDRGRGILILP

SEQ ID NO: 130 - protein, 13 aa, Artificial Sequence
  Synthetic Peptide
DMMIEMRRCYSNQ

SEQ ID NO: 131 - protein, 13 aa, Artificial Sequence
  Synthetic Peptide
MMIEMRRCYSNQL

SEQ ID NO: 132 - protein, 13 aa, Artificial Sequence
  Synthetic Peptide
VKKSRRRGAAQWA

SEQ ID NO: 133 - protein, 13 aa, Artificial Sequence
  Synthetic Peptide
GSAPPGRRHDLYD

SEQ ID NO: 134 - protein, 13 aa, Artificial Sequence
  Synthetic Peptide
SAPPGRRHDLYDI

SEQ ID NO: 135 - protein, 13 aa, Artificial Sequence
  Synthetic Peptide
KTNGAPRSASGQL

SEQ ID NO: 136 - protein, 13 aa, Artificial Sequence
  Synthetic Peptide
PAGYIIRGVFTRT

SEQ ID NO: 137 - protein, 13 aa, Artificial Sequence
  Synthetic Peptide
LLLVTTRGRNRLP

SEQ ID NO: 138 - protein, 13 aa, Artificial Sequence
  Synthetic Peptide
HSQLDVRSSTPTS

SEQ ID NO: 139 - protein, 13 aa, Artificial Sequence
  Synthetic Peptide
ITPEELRRELPAE

SEQ ID NO: 140 - protein, 13 aa, Artificial Sequence
  Synthetic Peptide
TPEELRRELPAEQ

SEQ ID NO: 141 - protein, 13 aa, Artificial Sequence
  Synthetic Peptide
KGEKLTRCKLASL

SEQ ID NO: 142 - protein, 13 aa, Artificial Sequence
  Synthetic Peptide
DRHYLLRGGGGPA

SEQ ID NO: 143 - protein, 13 aa, Artificial Sequence
  Synthetic Peptide
PSVSPDRGSTPTS

SEQ ID NO: 144 - protein, 13 aa, Artificial Sequence
  Synthetic Peptide
VQTAPYRGGPRGR

SEQ ID NO: 145 - protein, 13 aa, Artificial Sequence
  Synthetic Peptide
REAKFARYNLPNQ

SEQ ID NO: 146 - protein, 13 aa, Artificial Sequence
  Synthetic Peptide
QVTPLARRDILIT

SEQ ID NO: 147 - protein, 13 aa, Artificial Sequence
  Synthetic Peptide
DTAVSGRGLAKHS

SEQ ID NO: 148 - protein, 13 aa, Artificial Sequence
  Synthetic Peptide
PYRGGPRGRPREA

SEQ ID NO: 149 - protein, 13 aa, Artificial Sequence
  Synthetic Peptide
RGGPRGRPREAKF

SEQ ID NO: 150 - protein, 13 aa, Artificial Sequence
  Synthetic Peptide
LSMAHGRARPPMR

SEQ ID NO: 151 - protein, 13 aa, Artificial Sequence
  Synthetic Peptide
SHDYSSRGKGYER

SEQ ID NO: 152 - protein, 13 aa, Artificial Sequence
  Synthetic Peptide
GSFTDLRHPTDLL

SEQ ID NO: 153 - protein, 13 aa, Artificial Sequence
  Synthetic Peptide
DHRYGPRGDAVGF

SEQ ID NO: 154 - protein, 13 aa, Artificial Sequence
  Synthetic Peptide
QSQPTTRGTAPAA

SEQ ID NO: 155 - protein, 13 aa, Artificial Sequence
  Synthetic Peptide
SHPLPLRRYSSVS

SEQ ID NO: 156 - protein, 13 aa, Artificial Sequence
  Synthetic Peptide
PPTSLTRAGMSYY

SEQ ID NO: 157 - protein, 13 aa, Artificial Sequence
  Synthetic Peptide
TVYGLPRQVYDPK

SEQ ID NO: 158 - protein, 13 aa, Artificial Sequence
  Synthetic Peptide
LPVYLARPGSAAQ

SEQ ID NO: 159 - protein, 13 aa, Artificial Sequence
  Synthetic Peptide
SAAQTPRQKYGGM

SEQ ID NO: 160 - protein, 13 aa, Artificial Sequence
  Synthetic Peptide
TLPAPPRGGSPLT

SEQ ID NO: 161 - protein, 13 aa, Artificial Sequence
  Synthetic Peptide
AAYAAPRGSSPKQ

SEQ ID NO: 162 - protein, 13 aa, Artificial Sequence
  Synthetic Peptide
SQGTTGRAGHLAG

SEQ ID NO: 163 - protein, 13 aa, Artificial Sequence
  Synthetic Peptide
SPTKLQRGGSAPE

SEQ ID NO: 164 - protein, 13 aa, Artificial Sequence
  Synthetic Peptide
SQVDSVRGFGGKF

SEQ ID NO: 165 - protein, 13 aa, Artificial Sequence
  Synthetic Peptide
SSPVFPRAGFGTK

SEQ ID NO: 166 - protein, 13 aa, Artificial Sequence
  Synthetic Peptide
GGLGSLRSSRLGT

SEQ ID NO: 167 - protein, 13 aa, Artificial Sequence
  Synthetic Peptide
RVSSYRRTFGGAP

SEQ ID NO: 168 - protein, 13 aa, Artificial Sequence
  Synthetic Peptide
LSPMSQRPVLKVC

SEQ ID NO: 169 - protein, 13 aa, Artificial Sequence
  Synthetic Peptide
TSDRCQRGGNQWN

SEQ ID NO: 170 - protein, 13 aa, Artificial Sequence
  Synthetic Peptide
QGQLDVRMTSPSR

SEQ ID NO: 171 - protein, 13 aa, Artificial Sequence
  Synthetic Peptide
PSLTWARGRMDTQ

SEQ ID NO: 172 - protein, 13 aa, Artificial Sequence
  Synthetic Peptide
AAPRPSRGPSPGP

SEQ ID NO: 173 - protein, 13 aa, Artificial Sequence
  Synthetic Peptide
TPASIFRTPLQLD

SEQ ID NO: 174 - protein, 13 aa, Artificial Sequence
  Synthetic Peptide
RVAPGGRGAQLST

SEQ ID NO: 175 - protein, 13 aa, Artificial Sequence
  Synthetic Peptide
MDTQPDRKPSRIP

SEQ ID NO: 176 - protein, 13 aa, Artificial Sequence
  Synthetic Peptide
ASETVVRGLGPSR

SEQ ID NO: 177 - protein, 13 aa, Artificial Sequence
  Synthetic Peptide
RITSARRSYASET

SEQ ID NO: 178 - protein, 13 aa, Artificial Sequence
  Synthetic Peptide
RGLGPSRQLGTMP

SEQ ID NO: 179 - protein, 13 aa, Artificial Sequence
  Synthetic Peptide
QGPYGPRATGLGT

SEQ ID NO: 180 - protein, 13 aa, Artificial Sequence
  Synthetic Peptide
GQGRSSRGGQQGS

SEQ ID NO: 181 - protein, 13 aa, Artificial Sequence
  Synthetic Peptide
DGGSRSRGGGSTQ

SEQ ID NO: 182 - protein, 13 aa, Artificial Sequence
  Synthetic Peptide
NQPVGLRGGGGKQ

SEQ ID NO: 183 - protein, 13 aa, Artificial Sequence
  Synthetic Peptide
IYAVGGRDDTTEL

SEQ ID NO: 184 - protein, 13 aa, Artificial Sequence
  Synthetic Peptide
GSSGGGRGGSSSG

SEQ ID NO: 185 - protein, 13 aa, Artificial Sequence
  Synthetic Peptide
GSSGSHRGGSGGG

SEQ ID NO: 186 - protein, 13 aa, Artificial Sequence
  Synthetic Peptide
MSGSSSRGGGSGG

SEQ ID NO: 187 - protein, 13 aa, Artificial Sequence
  Synthetic Peptide
  misc_feature (11)..(13): Xaa can be any naturally occurring amino acid
VSTSYSRGTKXXX

SEQ ID NO: 188 - protein, 13 aa, Artificial Sequence
  Synthetic Peptide
SSRSLCRGGGGSR

SEQ ID NO: 189 - protein, 13 aa, Artificial Sequence
  Synthetic Peptide
GGSGGGRYGGGGS

SEQ ID NO: 190 - protein, 13 aa, Artificial Sequence
  Synthetic Peptide
HGGSGGRGVSVSS

SEQ ID NO: 191 - protein, 13 aa, Artificial Sequence
  Synthetic Peptide
GSGGVFRAPSIHG

SEQ ID NO: 192 - protein, 13 aa, Artificial Sequence
  Synthetic Peptide
VSVSSTRFVTSSS

SEQ ID NO: 193 - protein, 13 aa, Artificial Sequence
  Synthetic Peptide
GSYGGVRGGSFSG

SEQ ID NO: 194 - protein, 13 aa, Artificial Sequence
  Synthetic Peptide
TGGGSVRIGSGGV

SEQ ID NO: 195 - protein, 13 aa, Artificial Sequence
  Synthetic Peptide
SRHGGGRGGSGGG

SEQ ID NO: 196 - protein, 13 aa, Artificial Sequence
  Synthetic Peptide
RGSYGGRGGGGGG

SEQ ID NO: 197 - protein, 13 aa, Artificial Sequence
  Synthetic Peptide
SSGGGSRGGSGGG

SEQ ID NO: 198 - protein, 13 aa, Artificial Sequence
  Synthetic Peptide
SSGGGSRGGSSSG

SEQ ID NO: 199 - protein, 13 aa, Artificial Sequence
  Synthetic Peptide
SVRGASRGFSSGS

SEQ ID NO: 200 - protein, 13 aa, Artificial Sequence
  Synthetic Peptide
LGPRFTRGGGGLG

SEQ ID NO: 201 - protein, 13 aa, Artificial Sequence
  Synthetic Peptide
VSVCRSRGSGGSS

SEQ ID NO: 202 - protein, 13 aa, Artificial Sequence
  Synthetic Peptide
GGGTGSRGGGGGG

SEQ ID NO: 203 - protein, 13 aa, Artificial Sequence
  Synthetic Peptide
SYVSSSRSATKYG

SEQ ID NO: 204 - protein, 13 aa, Artificial Sequence
  Synthetic Peptide
GGIGGGRGFGGGG

SEQ ID NO: 205 - protein, 13 aa, Artificial Sequence
  Synthetic Peptide
SGFCQSRGPGGGF

SEQ ID NO: 206 - protein, 13 aa, Artificial Sequence
  Synthetic Peptide
SGGGSSRTQILQT

SEQ ID NO: 207 - protein, 13 aa, Artificial Sequence
  Synthetic Peptide
GYGGGGRFGGGFG

SEQ ID NO: 208 - protein, 13 aa, Artificial Sequence
  Synthetic Peptide
  misc_feature (13)..(13): Xaa can be any naturally occurring amino acid
TSTHSSRRHVVEX

SEQ ID NO: 209 - protein, 13 aa, Artificial Sequence
  Synthetic Peptide
SAFSGARGRTGFS

SEQ ID NO: 210 - protein, 13 aa, Artificial Sequence
  Synthetic Peptide
QVTPLARGTFQRA

SEQ ID NO: 211 - protein, 13 aa, Artificial Sequence
  Synthetic Peptide
MYQMSLRGKASGA

SEQ ID NO: 212 - protein, 13 aa, Artificial Sequence
  Synthetic Peptide
PSESASRPPWVTD

SEQ ID NO: 213 - protein, 13 aa, Artificial Sequence
  Synthetic Peptide
SKQTLPRGAPAYN

SEQ ID NO: 214 - protein, 13 aa, Artificial Sequence
  Synthetic Peptide
APAPKPRVVTTAS

SEQ ID NO: 215 - protein, 13 aa, Artificial Sequence
  Synthetic Peptide
MSVGQGRGKRRRL

SEQ ID NO: 216 - protein, 13 aa, Artificial Sequence
  Synthetic Peptide
GFGYGGRASDYKS

SEQ ID NO: 217 - protein, 13 aa, Artificial Sequence
  Synthetic Peptide
RFFSGDRGAPKRG

SEQ ID NO: 218 - protein, 13 aa, Artificial Sequence
  Synthetic Peptide
PLPSHARSRPGLC

SEQ ID NO: 219 - protein, 13 aa, Artificial Sequence
  Synthetic Peptide
ILDSIGRFFSGDR

SEQ ID NO: 220 - protein, 13 aa, Artificial Sequence
  Synthetic Peptide
RGLSLSRFSWGGR

SEQ ID NO: 221 - protein, 13 aa, Artificial Sequence
  Synthetic Peptide
SYETSDRCYTTEK

SEQ ID NO: 222 - protein, 13 aa, Artificial Sequence
  Synthetic Peptide
RGVSGDREENSFS

SEQ ID NO: 223 - protein, 13 aa, Artificial Sequence
  Synthetic Peptide
VLTLEIRKPCPYD

SEQ ID NO: 224 - protein, 13 aa, Artificial Sequence
  Synthetic Peptide
STAYSSRSLAARR

SEQ ID NO: 225 - protein, 13 aa, Artificial Sequence
  Synthetic Peptide
QNPCGSRLQPPGP

SEQ ID NO: 226 - protein, 13 aa, Artificial Sequence
  Synthetic Peptide
SIVIQPRQCTEQR

SEQ ID NO: 227 - protein, 13 aa, Artificial Sequence
  Synthetic Peptide
LSHFSNRGARLFK

SEQ ID NO: 228 - protein, 13 aa, Artificial Sequence
  Synthetic Peptide
ETRGRNRGGPILG

SEQ ID NO: 229 - protein, 13 aa, Artificial Sequence
  Synthetic Peptide
FEESKGRGFSIVT

SEQ ID NO: 230 - protein, 13 aa, Artificial Sequence
  Synthetic Peptide
FEKTKGRGFTPVV

SEQ ID NO: 231 - protein, 13 aa, Artificial Sequence
  Synthetic Peptide
VHISSVRSGYSTA

SEQ ID NO: 232 - protein, 13 aa, Artificial Sequence
  Synthetic Peptide
SSSLSVRRSYSSS

SEQ ID NO: 233 - protein, 13 aa, Artificial Sequence
  Synthetic Peptide
HSESSDRGGPSSK

SEQ ID NO: 234 - protein, 13 aa, Artificial Sequence
  Synthetic Peptide
ALHGQLRGLIPGS

SEQ ID NO: 235 - protein, 13 aa, Artificial Sequence
  Synthetic Peptide
LSSASSRGRPLRV

SEQ ID NO: 236 - protein, 13 aa, Artificial Sequence
  Synthetic Peptide
GSTAGSRTGSRTG

SEQ ID NO: 237 - protein, 13 aa, Artificial Sequence
  Synthetic Peptide
SRAGSRRGSFDAT

SEQ ID NO: 238 - protein, 13 aa, Artificial Sequence
  Synthetic Peptide
SPSSSARLGSFRA

SEQ ID NO: 239 - protein, 13 aa, Artificial Sequence
  Synthetic Peptide
LSYAGGRPPSYAG

SEQ ID NO: 240 - protein, 13 aa, Artificial Sequence
  Synthetic Peptide
GSPSRSRLSYAGG

SEQ ID NO: 241 - protein, 13 aa, Artificial Sequence
  Synthetic Peptide
YSGPPSRGSPVRQ

SEQ ID NO: 242 - protein, 13 aa, Artificial Sequence
  Synthetic Peptide
QHALALRGQQDRM

SEQ ID NO: 243 - protein, 13 aa, Artificial Sequence
  Synthetic Peptide
NSASDLRGQLQQL

SEQ ID NO: 244 - protein, 13 aa, Artificial Sequence
  Synthetic Peptide
LVPNLPRAGLPPS

SEQ ID NO: 245 - protein, 13 aa, Artificial Sequence
  Synthetic Peptide
APAETLRPFSPPQ

SEQ ID NO: 246 - protein, 13 aa, Artificial Sequence
  Synthetic Peptide
PPPPPARMRSPQP

SEQ ID NO: 247 - protein, 13 aa, Artificial Sequence
  Synthetic Peptide
SPARNFRGAAFSP

SEQ ID NO: 248 - protein, 13 aa, Artificial Sequence
  Synthetic Peptide
TAPVASRVRSPPS

SEQ ID NO: 249 - protein, 13 aa, Artificial Sequence
  Synthetic Peptide
IFNRSARPFTPGL

SEQ ID NO: 250 - protein, 13 aa, Artificial Sequence
  Synthetic Peptide
PGLQGQRSGTTSV

SEQ ID NO: 251 - protein, 13 aa, Artificial Sequence
  Synthetic Peptide
RVQEIRRFSTPAP

SEQ ID NO: 252 - protein, 13 aa, Artificial Sequence
  Synthetic Peptide
PTVLVPRAATTLD

SEQ ID NO: 253 - protein, 13 aa, Artificial Sequence
  Synthetic Peptide
KYSPNIRAPPPIA

SEQ ID NO: 254 - protein, 13 aa, Artificial Sequence
  Synthetic Peptide
FFPQAARTLPNKA

SEQ ID NO: 255 - protein, 13 aa, Artificial Sequence
  Synthetic Peptide
APSIFNRSARPFT

SEQ ID NO: 256 - protein, 13 aa, Artificial Sequence
  Synthetic Peptide
SLNPGLRPRSPSP

SEQ ID NO: 257 - protein, 13 aa, Artificial Sequence
  Synthetic Peptide
NPGLRPRSPSPTP

SEQ ID NO: 258 - protein, 13 aa, Artificial Sequence
  Synthetic Peptide
PPRLQGRGGELFA

SEQ ID NO: 259 - protein, 13 aa, Artificial Sequence
  Synthetic Peptide
LSEVSGRGVQLFE

SEQ ID NO: 260 - protein, 13 aa, Artificial Sequence
  Synthetic Peptide
LQMGSNRGASQAG

SEQ ID NO: 261 - protein, 13 aa, Artificial Sequence
  Synthetic Peptide
LQMGTNRGASQAG

SEQ ID NO: 262 - protein, 13 aa, Artificial Sequence
  Synthetic Peptide
GSEVIGRGGPRKA

SEQ ID NO: 263 - protein, 13 aa, Artificial Sequence
  Synthetic Peptide
SKVAACRGGQNLP

SEQ ID NO: 264 - protein, 13 aa, Artificial Sequence
  Synthetic Peptide
NDSGGSRPPILPP

SEQ ID NO: 265 - protein, 13 aa, Artificial Sequence
  Synthetic Peptide
ILPPGGRATSAKP

SEQ ID NO: 266 - protein, 13 aa, Artificial Sequence
  Synthetic Peptide
RPPPPARGGGSGG

SEQ ID NO: 267 - protein, 13 aa, Artificial Sequence
  Synthetic Peptide
ASRGIGRGIALQL

SEQ ID NO: 268 - protein, 13 aa, Artificial Sequence
  Synthetic Peptide
PQPSPGRGGTSTT

SEQ ID NO: 269 - protein, 13 aa, Artificial Sequence
  Synthetic Peptide
RASTLRRGGPTSV

SEQ ID NO: 270 - protein, 13 aa, Artificial Sequence
  Synthetic Peptide
EGSGSVRGGGGGN

SEQ ID NO: 271 - protein, 13 aa, Artificial Sequence
  Synthetic Peptide
IGGEVGRGQDASY

SEQ ID NO: 272 - protein, 13 aa, Artificial Sequence
  Synthetic Peptide
SPLQSARSLPGNA

SEQ ID NO: 273 - protein, 13 aa, Artificial Sequence
  Synthetic Peptide
PDRGPLRPFVPEQ

SEQ ID NO: 274 - protein, 13 aa, Artificial Sequence
  Synthetic Peptide
AALVLARGGSKGI

SEQ ID NO: 275 - protein, 13 aa, Artificial Sequence
  Synthetic Peptide
RSRGAGRGLEKPP

SEQ ID NO: 276 - protein, 13 aa, Artificial Sequence
  Synthetic Peptide
SSFFGDRGSGSRG

SEQ ID NO: 277 - protein, 13 aa, Artificial Sequence
  Synthetic Peptide
DRGSGSRGRFDDR

SEQ ID NO: 278 - protein, 13 aa, Artificial Sequence
  Synthetic Peptide
GSGSRGRFDDRGR

SEQ ID NO: 279 - protein, 13 aa, Artificial Sequence
  Synthetic Peptide
GGHGGSRGFGGGG

SEQ ID NO: 280 - protein, 13 aa, Artificial Sequence
  Synthetic Peptide
SSFSSSRASSSRS

SEQ ID NO: 281 - protein, 13 aa, Artificial Sequence
  Synthetic Peptide
RFDDRGRGDYDGI

SEQ ID NO: 282 - protein, 13 aa, Artificial Sequence
  Synthetic Peptide
YDGIGGRGDRSGF

SEQ ID NO: 283 - protein, 13 aa, Artificial Sequence
  Synthetic Peptide
GGPGTKRGFGFGG

SEQ ID NO: 284 - protein, 13 aa, Artificial Sequence
  Synthetic Peptide
GSRGRLRGGLGWE

SEQ ID NO: 285 - protein, 13 aa, Artificial Sequence
  Synthetic Peptide
  misc_feature (13)..(13): Xaa can be any naturally occurring amino acid
LAPPGGRSSGIWX

SEQ ID NO: 286 - protein, 13 aa, Artificial Sequence
  Synthetic Peptide
SQDMLMRSLNTVA

SEQ ID NO: 287 - protein, 13 aa, Artificial Sequence
  Synthetic Peptide
MKPAGGRGGWGWG

SEQ ID NO: 288 - protein, 13 aa, Artificial Sequence
  Synthetic Peptide
EVMACGRPQGTAV

SEQ ID NO: 289 - protein, 13 aa, Artificial Sequence
  Synthetic Peptide
KVAEYARRFGVPV

SEQ ID NO: 290 - protein, 13 aa, Artificial Sequence
  Synthetic Peptide
TGVAQVRPTGILN

SEQ ID NO: 291 - protein, 13 aa, Artificial Sequence
  Synthetic Peptide
PQLPLTRMPSVSQ

SEQ ID NO: 292 - protein, 13 aa, Artificial Sequence
  Synthetic Peptide
ITTVQQRGAAVIK

SEQ ID NO: 293 - protein, 13 aa, Artificial Sequence
  Synthetic Peptide
LEQTNPRGGKVTV

SEQ ID NO: 294 - protein, 13 aa, Artificial Sequence
  Synthetic Peptide
RAARLCRAGAHRL

SEQ ID NO: 295 - protein, 13 aa, Artificial Sequence
  Synthetic Peptide
RPGSGGRGRFRGG

SEQ ID NO: 296 - protein, 13 aa, Artificial Sequence
  Synthetic Peptide
DPTGTGRGGASIY

SEQ ID NO: 297 - protein, 13 aa, Artificial Sequence
  Synthetic Peptide
DPTGTGRGGSSIW

SEQ ID NO: 298 - protein, 13 aa, Artificial Sequence
  Synthetic Peptide
TLQDVIRRFKASK

SEQ ID NO: 299 - protein, 13 aa, Artificial Sequence
  Synthetic Peptide
FYAQADRCATRRC

SEQ ID NO: 300 - protein, 13 aa, Artificial Sequence
  Synthetic Peptide
LTGMAFRVPTPNV

SEQ ID NO: 301 - protein, 13 aa, Artificial Sequence
  Synthetic Peptide
AAGATARPAVRVP

SEQ ID NO: 302 - protein, 13 aa, Artificial Sequence
  Synthetic Peptide
PFGHGLRPVDVGF

SEQ ID NO: 303 - protein, 13 aa, Artificial Sequence
  Synthetic Peptide
NRRLVGRGVGPVS

SEQ ID NO: 304 - protein, 13 aa, Artificial Sequence
  Synthetic Peptide
SLPQHQRGGFGGA

SEQ ID NO: 305 - protein, 13 aa, Artificial Sequence
  Synthetic Peptide
FAFYNPRLQGKNV

SEQ ID NO: 306 - protein, 13 aa, Artificial Sequence
  Synthetic Peptide
APPSYGRGGEVRG

SEQ ID NO: 307 - protein, 13 aa, Artificial Sequence
  Synthetic Peptide
DLLPFCRPGPEGQ

SEQ ID NO: 308 - protein, 13 aa, Artificial Sequence
  Synthetic Peptide
AAAAASRGAPRTF

SEQ ID NO: 309 - protein, 13 aa, Artificial Sequence
  Synthetic Peptide
HTMHVGRGGDVFG

SEQ ID NO: 310 - protein, 13 aa, Artificial Sequence
  Synthetic Peptide
PARPGSRGPAPGP

SEQ ID NO: 311 - protein, 13 aa, Artificial Sequence
  Synthetic Peptide
QAATLARGSGRPA

SEQ ID NO: 312 - protein, 13 aa, Artificial Sequence
  Synthetic Peptide
QPVKYSRGGVRPV

SEQ ID NO: 313 - protein, 13 aa, Artificial Sequence
  Synthetic Peptide
ETWDLLRLPLDRE

SEQ ID NO: 314 - protein, 13 aa, Artificial Sequence
  Synthetic Peptide
LSDRSDRSSLKRQ

SEQ ID NO: 315 - protein, 13 aa, Artificial Sequence
  Synthetic Peptide
PGRAPRRGAGGHP

SEQ ID NO: 316 - protein, 13 aa, Artificial Sequence
  Synthetic Peptide
HPRGYDRGGSMGR

SEQ ID NO: 317 - protein, 13 aa, Artificial Sequence
  Synthetic Peptide
GRGHAGRIIHKLF

SEQ ID NO: 318 - protein, 13 aa, Artificial Sequence
  Synthetic Peptide
RISQLFRGSGAGG

SEQ ID NO: 319 - protein, 13 aa, Artificial Sequence
  Synthetic Peptide
KSSKLGRGVALAQ

SEQ ID NO: 320 - protein, 13 aa, Artificial Sequence
  Synthetic Peptide
RERDRRRGSTPWG

SEQ ID NO: 321 - protein, 13 aa, Artificial Sequence
  Synthetic Peptide
GSCRGGRRRRPIS

SEQ ID NO: 322 - protein, 13 aa, Artificial Sequence
  Synthetic Peptide
ASGVTARGGVGQV

SEQ ID NO: 323 - protein, 13 aa, Artificial Sequence
  Synthetic Peptide
LENIFSRGANRMR

SEQ ID NO: 324 - protein, 13 aa, Artificial Sequence
  Synthetic Peptide
LLSQHSRGGCSSE

SEQ ID NO: 325 - protein, 13 aa, Artificial Sequence
  Synthetic Peptide
AAAGEPRARGAKR

SEQ ID NO: 326 - protein, 13 aa, Artificial Sequence
  Synthetic Peptide
RSVGELRLLFEAR

SEQ ID NO: 327 - protein, 13 aa, Artificial Sequence
  Synthetic Peptide
RLLFEARCAAVAA

SEQ ID NO: 328 - protein, 13 aa, Artificial Sequence
  Synthetic Peptide
ARGAKRRGGQVPN

SEQ ID NO: 329 - protein, 13 aa, Artificial Sequence
  Synthetic Peptide
TPQPSGRAALSPG

SEQ ID NO: 330 - protein, 13 aa, Artificial Sequence
  Synthetic Peptide
SVFSPGRGASFLF

SEQ ID NO: 331 - protein, 13 aa, Artificial Sequence
  Synthetic Peptide
SPTKVWRGGEGAS

SEQ ID NO: 332 - protein, 13 aa, Artificial Sequence
  Synthetic Peptide
LNENIDRVVFVGN

SEQ ID NO: 333 - protein, 13 aa, Artificial Sequence
  Synthetic Peptide
FVGNFLRINMVSM

SEQ ID NO: 334 - protein, 13 aa, Artificial Sequence
  Synthetic Peptide
TLATPKRGGNNNG

SEQ ID NO: 335 - protein, 13 aa, Artificial Sequence
  Synthetic Peptide
GPGSFGRGGSLGL

SEQ ID NO: 336 - protein, 13 aa, Artificial Sequence
  Synthetic Peptide
VDAPHARAMHDGG

SEQ ID NO: 337 - protein, 13 aa, Artificial Sequence
  Synthetic Peptide
HDGGGPRRLCIEG

SEQ ID NO: 338 - protein, 13 aa, Artificial Sequence
  Synthetic Peptide
LQVERERGITVKA

SEQ ID NO: 339 - protein, 13 aa, Artificial Sequence
  Synthetic Peptide
TVTGLGRGQQQVF

SEQ ID NO: 340 - protein, 13 aa, Artificial Sequence
  Synthetic Peptide
RGPGTSRGGSPTR

SEQ ID NO: 341 - protein, 13 aa, Artificial Sequence
  Synthetic Peptide
SPTICRRGGTWFA

SEQ ID NO: 342 - protein, 13 aa, Artificial Sequence
  Synthetic Peptide
LKNRLRRGGPISF

SEQ ID NO: 343 - protein, 13 aa, Artificial Sequence
  Synthetic Peptide
ISFSSSRSGRRQL

SEQ ID NO: 344 - protein, 13 aa, Artificial Sequence
  Synthetic Peptide
RYLFVDRAVIYNP

SEQ ID NO: 345 - protein, 13 aa, Artificial Sequence
  Synthetic Peptide
GKRSGGRGSGGPE

SEQ ID NO: 346 - protein, 13 aa, Artificial Sequence
  Synthetic Peptide
IAGEQKRPPPPHS

SEQ ID NO: 347 - protein, 13 aa, Artificial Sequence
  Synthetic Peptide
LKQNFLRQTPTLP

SEQ ID NO: 348 - protein, 13 aa, Artificial Sequence
  Synthetic Peptide
PTLPAARGLGELQ

SEQ ID NO: 349 - protein, 13 aa, Artificial Sequence
  Synthetic Peptide
TRAASLRGGVGAP

SEQ ID NO: 350 - protein, 13 aa, Artificial Sequence
  Synthetic Peptide
MRGGPMRGGPGPA

SEQ ID NO: 351 - protein, 13 aa, Artificial Sequence
  Synthetic Peptide
GGPPNGRGGPGGG

SEQ ID NO: 352 - protein, 13 aa, Artificial Sequence
  Synthetic Peptide
SDRASARARREAR

SEQ ID NO: 353 - protein, 13 aa, Artificial Sequence
  Synthetic Peptide
VFFQSPRGGTGGS

SEQ ID NO: 354 - protein, 13 aa, Artificial Sequence
  Synthetic Peptide
ENDPEPRYLVHGS

SEQ ID NO: 355 - protein, 13 aa, Artificial Sequence
  Synthetic Peptide
RPTIPARAGVISA

SEQ ID NO: 356 - protein, 13 aa, Artificial Sequence
  Synthetic Peptide
KRPPPPRPVAPPA

SEQ ID NO: 357 - protein, 13 aa, Artificial Sequence
  Synthetic Peptide
AGYGAARPTIPAR

SEQ ID NO: 358 - protein, 13 aa, Artificial Sequence
  Synthetic Peptide
GVASAGRGAGRET

SEQ ID NO: 359 - protein, 13 aa, Artificial Sequence
  Synthetic Peptide
GSPSEGRGYPSPG

SEQ ID NO: 360 - protein, 13 aa, Artificial Sequence
  Synthetic Peptide
DADEQCRFQHGVK

SEQ ID NO: 361 - protein, 13 aa, Artificial Sequence
  Synthetic Peptide
SWRHPVRGSLFIE

SEQ ID NO: 362 - protein, 13 aa, Artificial Sequence
  Synthetic Peptide
SNAECGRGGPGPA

SEQ ID NO: 363 - protein, 13 aa, Artificial Sequence
  Synthetic Peptide
IFEDVGRQVLATH

SEQ ID NO: 364 - protein, 13 aa, Artificial Sequence
  Synthetic Peptide
DPFGCQRGGMIVD

SEQ ID NO: 365 - protein, 13 aa, Artificial Sequence
  Synthetic Peptide
SSGLPNRLPPGAV

SEQ ID NO: 366 - protein, 13 aa, Artificial Sequence
  Synthetic Peptide
YDSSAPRLGRFCG

SEQ ID NO: 367 - protein, 13 aa, Artificial Sequence
  Synthetic Peptide
SAPRLGRFCGSGP

SEQ ID NO: 368 - protein, 13 aa, Artificial Sequence
  Synthetic Peptide
SRRAAGRGWGLGG

SEQ ID NO: 369 - protein, 13 aa, Artificial Sequence
  Synthetic Peptide
ISLAQLRLQHIQQ

SEQ ID NO: 370 - protein, 13 aa, Artificial Sequence
  Synthetic Peptide
QQLQQMRLQQPPA

SEQ ID NO: 371 - protein, 13 aa, Artificial Sequence
  Synthetic Peptide
VKARRRRGGVSAE

SEQ ID NO: 372 - protein, 13 aa, Artificial Sequence
  Synthetic Peptide
QPALTPRKRATVQ

SEQ ID NO: 373 - protein, 13 aa, Artificial Sequence
  Synthetic Peptide
HLSSKGRGSLASG

SEQ ID NO: 374 - protein, 13 aa, Artificial Sequence
  Synthetic Peptide
LPSRGPRGGGAGE

SEQ ID NO: 375 - protein, 13 aa, Artificial Sequence
  Synthetic Peptide
PPPPSARSTPLPG

SEQ ID NO: 376 - protein, 13 aa, Artificial Sequence
  Synthetic Peptide
GAGDEARGGGSPT

SEQ ID NO: 377 - protein, 13 aa, Artificial Sequence
  Synthetic Peptide
SPLHTPRASPTGT

SEQ ID NO: 378 - protein, 13 aa, Artificial Sequence
  Synthetic Peptide
TQTLPSRGPRGGG

SEQ ID NO: 379 - protein, 13 aa, Artificial Sequence
  Synthetic Peptide
VGGAAWRSRLNSI

SEQ ID NO: 380 - protein, 13 aa, Artificial Sequence
  Synthetic Peptide
VSMRLHRGAPVNV

SEQ ID NO: 381 - protein, 13 aa, Artificial Sequence
  Synthetic Peptide
VSMRLHRGAPANV

SEQ ID NO: 382 - protein, 13 aa, Artificial Sequence
  Synthetic Peptide
SPWQANRPTAPGT

SEQ ID NO: 383 - protein, 13 aa, Artificial Sequence
  Synthetic Peptide
AWPGTLRSGMVPR

SEQ ID NO: 384 - protein, 13 aa, Artificial Sequence
  Synthetic Peptide
DPLDFPRLPDPQA

SEQ ID NO: 385 - protein, 13 aa, Artificial Sequence
  Synthetic Peptide
LSQTRSRGSTNLF

SEQ ID NO: 386 - protein, 13 aa, Artificial Sequence
  Synthetic Peptide
SATTPDRIRFPRG

SEQ ID NO: 387 - protein, 13 aa, Artificial Sequence
  Synthetic Peptide
GQSLGDRGRRLSA

SEQ ID NO: 388 - protein, 13 aa, Artificial Sequence
  Synthetic Peptide
PLYHYGRGINPAD

SEQ ID NO: 389 - protein, 13 aa, Artificial Sequence
  Synthetic Peptide
QILPGDRKPLYHY

SEQ ID NO: 390 - protein, 13 aa, Artificial Sequence
  Synthetic Peptide
GSDTYPRGPTKLP

SEQ ID NO: 391 - protein, 13 aa, Artificial Sequence
  Synthetic Peptide
FLSRPARGLYSRS

SEQ ID NO: 392 - protein, 13 aa, Artificial Sequence
  Synthetic Peptide
DQAQFGRGRGWQP

SEQ ID NO: 393 - protein, 13 aa, Artificial Sequence
  Synthetic Peptide
TGHSDIRLPPAEF

SEQ ID NO: 394 - protein, 13 aa, Artificial Sequence
  Synthetic Peptide
RRKSQGRGSSCSS

SEQ ID NO: 395 - protein, 13 aa, Artificial Sequence
  Synthetic Peptide
QGEAEPRGRHRRA

SEQ ID NO: 396 - protein, 13 aa, Artificial Sequence
  Synthetic Peptide
GATRLTRGGLGEG

SEQ ID NO: 397 - protein, 13 aa, Artificial Sequence
  Synthetic Peptide
AKVGAGRGVLVTG

SEQ ID NO: 398 - protein, 13 aa, Artificial Sequence
  Synthetic Peptide
RRPELRRGSSAES

SEQ ID NO: 399 - protein, 13 aa, Artificial Sequence
  Synthetic Peptide
TQSGTPRGGALLL

SEQ ID NO: 400 - protein, 13 aa, Artificial Sequence
  Synthetic Peptide
NQGSVPRGGPSAT

SEQ ID NO: 401 - protein, 13 aa, Artificial Sequence
  Synthetic Peptide
ALMEAGRGTGSAG

SEQ ID NO: 402 - protein, 13 aa, Artificial Sequence
  Synthetic Peptide
AGMAEPRARAARL

SEQ ID NO: 403 - protein, 13 aa, Artificial Sequence
  Synthetic Peptide
SPVRHVRAPTPSP

SEQ ID NO: 404 - protein, 13 aa, Artificial Sequence
  Synthetic Peptide
PTPSPVRSVSPAG

SEQ ID NO: 405 - protein, 13 aa, Artificial Sequence
  Synthetic Peptide
SVSPAGRISTSPI

SEQ ID NO: 406 - protein, 13 aa, Artificial Sequence
  Synthetic Peptide
ISTSPIRSVKSPL

SEQ ID NO: 407 - protein, 13 aa, Artificial Sequence
  Synthetic Peptide
PAMSPARMSPARM

SEQ ID NO: 408 - protein, 13 aa, Artificial Sequence
  Synthetic Peptide
HSPSPVRHVRAPT

SEQ ID NO: 409 - protein, 13 aa, Artificial Sequence
  Synthetic Peptide
PPKPKSRSPTPPS

SEQ ID NO: 410 - protein, 13 aa, Artificial Sequence
  Synthetic Peptide
AKAQLARQQSPSP

SEQ ID NO: 411 - protein, 13 aa, Artificial Sequence
  Synthetic Peptide
QSPSPIRHSPSPV

SEQ ID NO: 412 - protein, 13 aa, Artificial Sequence
  Synthetic Peptide
IQAPGPRAGPCIL

SEQ ID NO: 413 - protein, 13 aa, Artificial Sequence
  Synthetic Peptide
ARRGAGRGGGAPP

SEQ ID NO: 414 - protein, 13 aa, Artificial Sequence
  Synthetic Peptide
LWEKARRGAGRGG

SEQ ID NO: 415 - protein, 13 aa, Artificial Sequence
  Synthetic Peptide
ASTAYTRLTIFNI

SEQ ID NO: 416 - protein, 13 aa, Artificial Sequence
  Synthetic Peptide
AASPAPRGGPEHR

SEQ ID NO: 417 - protein, 13 aa, Artificial Sequence
  Synthetic Peptide
RFIHGHRGGGGGG

SEQ ID NO: 418 - protein, 13 aa, Artificial Sequence
  Synthetic Peptide
SGHGEERGGGAKA

SEQ ID NO: 419 - protein, 13 aa, Artificial Sequence
  Synthetic Peptide
LPTHRRRGSFSSE

SEQ ID NO: 420 - protein, 13 aa, Artificial Sequence
  Synthetic Peptide
RSPADTRLPAFLS

SEQ ID NO: 421 - protein, 13 aa, Artificial Sequence
  Synthetic Peptide
PAFLSLRFLKAPE

SEQ ID NO: 422 - protein, 13 aa, Artificial Sequence
  Synthetic Peptide
PSSVLPRGVPSVP

SEQ ID NO: 423 - protein, 13 aa, Artificial Sequence
  Synthetic Peptide
RINNKARAGSAFL

SEQ ID NO: 424 - protein, 13 aa, Artificial Sequence
  Synthetic Peptide
DKEDISRDTEGMD

SEQ ID NO: 425 - protein, 13 aa, Artificial Sequence
  Synthetic Peptide
WVRGLNRIQTQID

SEQ ID NO: 426 - protein, 13 aa, Artificial Sequence
  Synthetic Peptide
SLVPIGRGQRELI

SEQ ID NO: 427 - protein, 13 aa, Artificial Sequence
  Synthetic Peptide
SVQNSERGKKIGS

SEQ ID NO: 428 - protein, 13 aa, Artificial Sequence
  Synthetic Peptide
RGAGGSRQGGQPG

SEQ ID NO: 429 - protein, 13 aa, Artificial Sequence
  Synthetic Peptide
GGGERARGGGAGG

SEQ ID NO: 430 - protein, 13 aa, Artificial Sequence
  Synthetic Peptide
AVLRGARVFLRQK

SEQ ID NO: 431 - protein, 13 aa, Artificial Sequence
  Synthetic Peptide
HYRRRRRGGPGPG

SEQ ID NO: 432 - protein, 13 aa, Artificial Sequence
  Synthetic Peptide
TFEDRARHRQSQR

SEQ ID NO: 433 - protein, 13 aa, Artificial Sequence
  Synthetic Peptide
YKPHRNRGSPGGC

SEQ ID NO: 434 - protein, 13 aa, Artificial Sequence
  Synthetic Peptide
LGDDDVRTDLKQG

SEQ ID NO: 435 - protein, 13 aa, Artificial Sequence
  Synthetic Peptide
GPPRPNRGMPQMN

SEQ ID NO: 436 - protein, 13 aa, Artificial Sequence
  Synthetic Peptide
LAAGPGRCAGRVE

SEQ ID NO: 437 - protein, 13 aa, Artificial Sequence
  Synthetic Peptide
SGSLRVRLAAGPG

SEQ ID NO: 438 - protein, 13 aa, Artificial Sequence
  Synthetic Peptide
HTLHVGRGGDAFG

SEQ ID NO: 439 - protein, 13 aa, Artificial Sequence
  Synthetic Peptide
MLELRHRGGCPGP

SEQ ID NO: 440 - protein, 13 aa, Artificial Sequence
  Synthetic Peptide
AHRGGHRGRSSAA

SEQ ID NO: 441 - protein, 13 aa, Artificial Sequence
  Synthetic Peptide
LLEGPLRLSPLLP

SEQ ID NO: 442 - protein, 13 aa, Artificial Sequence
  Synthetic Peptide
LPGGGGRGSRGPE

SEQ ID NO: 443 - protein, 13 aa, Artificial Sequence
  Synthetic Peptide
LFPVDPRSQFMRR

SEQ ID NO: 444 - protein, 13 aa, Artificial Sequence
  Synthetic Peptide
ECEAAGRGFFPPP

SEQ ID NO: 445 - protein, 13 aa, Artificial Sequence
  Synthetic Peptide
RDYFPPRDFPGPP

SEQ ID NO: 446 - protein, 13 aa, Artificial Sequence
  Synthetic Peptide
VDCVMVRNEITGH

SEQ ID NO: 447 - protein, 13 aa, Artificial Sequence
  Synthetic Peptide
SLSWKGRGGPGDI

SEQ ID NO: 448 - protein, 13 aa, Artificial Sequence
  Synthetic Peptide
APDGSCRCDPGWE

SEQ ID NO: 449 - protein, 13 aa, Artificial Sequence
  Synthetic Peptide
SPRTQGRGGPASV

SEQ ID NO: 450 - protein, 13 aa, Artificial Sequence
  Synthetic Peptide
PASVYPRHFGPVP

SEQ ID NO: 451 - protein, 13 aa, Artificial Sequence
  Synthetic Peptide
PARGRPRGVISTP

SEQ ID NO: 452 - protein, 13 aa, Artificial Sequence
  Synthetic Peptide
ISTPVIRTFGRGG

SEQ ID NO: 453 - protein, 13 aa, Artificial Sequence
  Synthetic Peptide
LSLHNSRGTSSSE

SEQ ID NO: 454 - protein, 13 aa, Artificial Sequence
  Synthetic Peptide
SSEMSARCGFDDS

SEQ ID NO: 455 - protein, 13 aa, Artificial Sequence
  Synthetic Peptide
EGESHTRILTPVS

SEQ ID NO: 456 - protein, 13 aa, Artificial Sequence
  Synthetic Peptide
AEKVLSRALMYIP

SEQ ID NO: 457 - protein, 13 aa, Artificial Sequence
  Synthetic Peptide
ASHRRHRGGDLGT

SEQ ID NO: 458 - protein, 13 aa, Artificial Sequence
  Synthetic Peptide
VNLWKRRGSSGET

SEQ ID NO: 459 - protein, 13 aa, Artificial Sequence
  Synthetic Peptide
QNEKSTRGQHLWQ

SEQ ID NO: 460 - protein, 13 aa, Artificial Sequence
  Synthetic Peptide
LALGSPRLVRRAP

SEQ ID NO: 461 - protein, 13 aa, Artificial Sequence
  Synthetic Peptide
PPLPGARGGLGLL

SEQ ID NO: 462 - protein, 13 aa, Artificial Sequence
  Synthetic Peptide
ATWTLGRGYRSPL

SEQ ID NO: 463 - protein, 13 aa, Artificial Sequence
  Synthetic Peptide
MGFGLERMAAPID

SEQ ID NO: 464 - protein, 13 aa, Artificial Sequence
  Synthetic Peptide
VKVHSGRGAEVES

SEQ ID NO: 465 - protein, 13 aa, Artificial Sequence
  Synthetic Peptide
VSQGQLRHTSQGM

SEQ ID NO: 466 - protein, 13 aa, Artificial Sequence
  Synthetic Peptide
RPESSSRGGSLET

SEQ ID NO: 467 - protein, 13 aa, Artificial Sequence
  Synthetic Peptide
PQGLFTRGTLLGR

SEQ ID NO: 468 - protein, 13 aa, Artificial Sequence
  Synthetic Peptide
QRRRHSRGAGGDR

SEQ ID NO: 469 - protein, 13 aa, Artificial Sequence
  Synthetic Peptide
RGAGGDRGFGLQR

SEQ ID NO: 470 - protein, 13 aa, Artificial Sequence
  Synthetic Peptide
HDPQGSRGSRRRR

SEQ ID NO: 471 - protein, 13 aa, Artificial Sequence
  Synthetic Peptide
YFFDRNRPSFDGI

SEQ ID NO: 472 - protein, 13 aa, Artificial Sequence
  Synthetic Peptide
THPGLLRGGAGGL

SEQ ID NO: 473 - protein, 13 aa, Artificial Sequence
  Synthetic Peptide
QYQELPRCPAPAP

SEQ ID NO: 474 - protein, 13 aa, Artificial Sequence
  Synthetic Peptide
NPVLQPRGGTSPY

SEQ ID NO: 475 - protein, 13 aa, Artificial Sequence
  Synthetic Peptide
GAGAGARGGAPAG

SEQ ID NO: 476 - protein, 13 aa, Artificial Sequence
  Synthetic Peptide
VSLQLKRGGGVGA

SEQ ID NO: 477 - protein, 13 aa, Artificial Sequence
  Synthetic Peptide
RTPSSFRQPFVTP

SEQ ID NO: 478 - protein, 13 aa, Artificial Sequence
  Synthetic Peptide
FVTPSSRSLLRHP

SEQ ID NO: 479 - protein, 13 aa, Artificial Sequence
  Synthetic Peptide
PGPGTRRGPLVGI

SEQ ID NO: 480 - protein, 13 aa, Artificial Sequence
  Synthetic Peptide
GPTSTPRASRRGL

SEQ ID NO: 481 - protein, 13 aa, Artificial Sequence
  Synthetic Peptide
TPRASRRGLSLGS

SEQ ID NO: 482 - protein, 13 aa, Artificial Sequence
  Synthetic Peptide
AKEVEVRMKAWNE

SEQ ID NO: 483 - protein, 13 aa, Artificial Sequence
  Synthetic Peptide
SRREQCRGTGGYQ

SEQ ID NO: 484 - protein, 13 aa, Artificial Sequence
  Synthetic Peptide
SQLLRSRGPSQVD

SEQ ID NO: 485 - protein, 13 aa, Artificial Sequence
  Synthetic Peptide
GPSQVDREGPGTP

SEQ ID NO: 486 - protein, 13 aa, Artificial Sequence
  Synthetic Peptide
VSSVGARGRGLGS

SEQ ID NO: 487 - protein, 13 aa, Artificial Sequence
  Synthetic Peptide
RGLGSYRGAAHLS

SEQ ID NO: 488 - protein, 13 aa, Artificial Sequence
  Synthetic Peptide
GHPGSPRGSLSRH

SEQ ID NO: 489 - protein, 13 aa, Artificial Sequence
  Synthetic Peptide
SAASLGRGRPGGQ

SEQ ID NO: 490 - protein, 13 aa, Artificial Sequence
  Synthetic Peptide
GGQRMSRGSVGPA

SEQ ID NO: 491 - protein, 13 aa, Artificial Sequence
  Synthetic Peptide
LPPAALRTPTPAG

SEQ ID NO: 492 - protein, 13 aa, Artificial Sequence
  Synthetic Peptide
TIMPLIRQIQTAV

SEQ ID NO: 493 - protein, 13 aa, Artificial Sequence
  Synthetic Peptide
LPLPLPRAPAPDP

SEQ ID NO: 494 - protein, 13 aa, Artificial Sequence
  Synthetic Peptide
FRGTPGRGSSPSS

SEQ ID NO: 495 - protein, 13 aa, Artificial Sequence
  Synthetic Peptide
EPSAAGRLSDSSS

SEQ ID NO: 496 - protein, 13 aa, Artificial Sequence
  Synthetic Peptide
QSLLSIRGSLFSP

SEQ ID NO: 497 - protein, 13 aa, Artificial Sequence
  Synthetic Peptide
GSLFSPRRNSRAS

SEQ ID NO: 498 - protein, 13 aa, Artificial Sequence
  Synthetic Peptide
SLFSPRRNSRASL

SEQ ID NO: 499 - protein, 13 aa, Artificial Sequence
  Synthetic Peptide
GTGPGGRGGAGGG

SEQ ID NO: 500 - protein, 13 aa, Artificial Sequence
  Synthetic Peptide
SKPRLQRGGSSAS

SEQ ID NO: 501 - protein, 13 aa, Artificial Sequence
  Synthetic Peptide
SRIQGGRGSPSGL

SEQ ID NO: 502 - protein, 13 aa, Artificial Sequence
  Synthetic Peptide
  misc_feature (9)..(13): Xaa can be any naturally occurring amino acid
QFNRGGRLXXXXX

SEQ ID NO: 503 - protein, 13 aa, Artificial Sequence
  Synthetic Peptide
GAEDLLRFTVPIP

SEQ ID NO: 504 - protein, 13 aa, Artificial Sequence
  Synthetic Peptide
AKTGALRGAALGP

SEQ ID NO: 505 - protein, 13 aa, Artificial Sequence
  Synthetic Peptide
LGLGSQRDLTHSD

SEQ ID NO: 506 - protein, 13 aa, Artificial Sequence
  Synthetic Peptide
ADNFCMRGLSNFY

SEQ ID NO: 507 - protein, 13 aa, Artificial Sequence
  Synthetic Peptide
QAGPGPRTGPPTT

SEQ ID NO: 508 - protein, 13 aa, Artificial Sequence
  Synthetic Peptide
GAPPAARPPASPS

SEQ ID NO: 509 - protein, 13 aa, Artificial Sequence
  Synthetic Peptide
ASPSPQRQAGAPQ

SEQ ID NO: 510 - protein, 13 aa, Artificial Sequence
  Synthetic Peptide
PPGGQQRQGPPQK

SEQ ID NO: 511 - protein, 13 aa, Artificial Sequence
  Synthetic Peptide
RDASPGRGSHSQS

SEQ ID NO: 512 - protein, 13 aa, Artificial Sequence
  Synthetic Peptide
PGPGPQRQGPPLQ

SEQ ID NO: 513 - protein, 13 aa, Artificial Sequence
  Synthetic Peptide
PTTQQPRPSGPGP

SEQ ID NO: 514 - protein, 13 aa, Artificial Sequence
  Synthetic Peptide
GQGRQSRPVAGGP

SEQ ID NO: 515 - protein, 13 aa, Artificial Sequence
  Synthetic Peptide
GPPLQQRPPPQGQ

SEQ ID NO: 516 - protein, 13 aa, Artificial Sequence
  Synthetic Peptide
RGGAAARVLLVID

SEQ ID NO: 517 - protein, 13 aa, Artificial Sequence
  Synthetic Peptide
AHGVSHRGGWRIA

SEQ ID NO: 518 - protein, 13 aa, Artificial Sequence
  Synthetic Peptide
TGPGGRRGGGSGE

SEQ ID NO: 519 - protein, 13 aa, Artificial Sequence
  Synthetic Peptide
RTIGRSRGAIISQ

SEQ ID NO: 520 - protein, 13 aa, Artificial Sequence
  Synthetic Peptide
SRPSIKRGASLHS

SEQ ID NO: 521 - protein, 13 aa, Artificial Sequence
  Synthetic Peptide
PRSGGARGSFAPG

SEQ ID NO: 522 - protein, 13 aa, Artificial Sequence
  Synthetic Peptide
GASSGGRGGGGGS

SEQ ID NO: 523 - protein, 13 aa, Artificial Sequence
  Synthetic Peptide
IVENICRGGKSRA

SEQ ID NO: 524 - protein, 13 aa, Artificial Sequence
  Synthetic Peptide
SGASVGRGRGAVG

SEQ ID NO: 525 - protein, 13 aa, Artificial Sequence
  Synthetic Peptide
ASVGRGRGAVGRK

SEQ ID NO: 526 - protein, 13 aa, Artificial Sequence
  Synthetic Peptide
GRGAVGRKATKKT

SEQ ID NO: 527 - protein, 13 aa, Artificial Sequence
  Synthetic Peptide
LMCRYPRWRPEVY

SEQ ID NO: 528 - protein, 13 aa, Artificial Sequence
  Synthetic Peptide
CRYPRWRPEVYSI

SEQ ID NO: 529 - protein, 13 aa, Artificial Sequence
  Synthetic Peptide
RIQMTRRQSVGRG

SEQ ID NO: 530 - protein, 13 aa, Artificial Sequence
  Synthetic Peptide
GPASSGRGCRLLR

SEQ ID NO: 531 - protein, 13 aa, Artificial Sequence
  Synthetic Peptide
SSGRGCRLLRPPE

SEQ ID NO: 532 - protein, 13 aa, Artificial Sequence
  Synthetic Peptide
PLSSPTRGGVKKV

SEQ ID NO: 533 - protein, 13 aa, Artificial Sequence
  Synthetic Peptide
LKAASRRGGDHMT

SEQ ID NO: 534 - protein, 13 aa, Artificial Sequence
  Synthetic Peptide
KAQAFERMMSPGG

SEQ ID NO: 535 - protein, 13 aa, Artificial Sequence
  Synthetic Peptide
SRREGTRGSSWSA

SEQ ID NO: 536 - protein, 13 aa, Artificial Sequence
  Synthetic Peptide
LSSSQGRGLKPHY

SEQ ID NO: 537 - protein, 13 aa, Artificial Sequence
  Synthetic Peptide
HRVSAGRGSMSSG

SEQ ID NO: 538 - protein, 13 aa, Artificial Sequence
  Synthetic Peptide
PSQRGGRGGGLHL

SEQ ID NO: 539 - protein, 13 aa, Artificial Sequence
  Synthetic Peptide
GGYGGSRDYYASR

SEQ ID NO: 540 - protein, 13 aa, Artificial Sequence
  Synthetic Peptide
RDYYASRSQGGSY

SEQ ID NO: 541 - protein, 13 aa, Artificial Sequence
  Synthetic Peptide
PTFEPARGGRGKG

SEQ ID NO: 542 - protein, 13 aa, Artificial Sequence
  Synthetic Peptide
SSFFSDRGGSGSR

SEQ ID NO: 543 - protein, 13 aa, Artificial Sequence
  Synthetic Peptide
EALSEPRTSLWSP

SEQ ID NO: 544 - protein, 13 aa, Artificial Sequence
  Synthetic Peptide
YHSPARRFGGPVH

SEQ ID NO: 545 - protein, 13 aa, Artificial Sequence
  Synthetic Peptide
VHHQAQRFRFSPM

SEQ ID NO: 546 - protein, 13 aa, Artificial Sequence
  Synthetic Peptide
YQSSARRYAGPLH

SEQ ID NO: 547 - protein, 13 aa, Artificial Sequence
  Synthetic Peptide
RPPGSGRGGSGGG

SEQ ID NO: 548 - protein, 13 aa, Artificial Sequence
  Synthetic Peptide
GGSWGGRSNSGPY

SEQ ID NO: 549 - protein, 13 aa, Artificial Sequence
  Synthetic Peptide
KQSGKKRGFGFVY

SEQ ID NO: 550 - protein, 13 aa, Artificial Sequence
  Synthetic Peptide
GGNFGGRSSGPYG

SEQ ID NO: 551 - protein, 13 aa, Artificial Sequence
  Synthetic Peptide
QYFAKPRNQGGYG

SEQ ID NO: 552 - protein, 13 aa, Artificial Sequence
  Synthetic Peptide
  misc_feature (10)..(13): Xaa can be any naturally occurring amino acid
SSYGSGRRFXXXX

SEQ ID NO: 553 - protein, 13 aa, Artificial Sequence
  Synthetic Peptide
  misc_feature (10)..(13): Xaa can be any naturally occurring amino acid
SGGYGSRRFXXXX

SEQ ID NO: 554 - protein, 13 aa, Artificial Sequence
  Synthetic Peptide
QSAGSQRGRGGGS

SEQ ID NO: 555 - protein, 13 aa, Artificial Sequence
  Synthetic Peptide
GGSFGGRSSGSPY

SEQ ID NO: 556 - protein, 13 aa, Artificial Sequence
  Synthetic Peptide
  misc_feature (9)..(13): Xaa can be any naturally occurring amino acid
GGYGSRRFXXXXX

SEQ ID NO: 557 - protein, 13 aa, Artificial Sequence
  Synthetic Peptide
AGSQRGRGGGSGN

SEQ ID NO: 558 - protein, 13 aa, Artificial Sequence
  Synthetic Peptide
PQTKRSRGFGFVT

SEQ ID NO: 559 - protein, 13 aa, Artificial Sequence
  Synthetic Peptide
NRNRGNRGSGGGQ

SEQ ID NO: 560 - protein, 13 aa, Artificial Sequence
  Synthetic Peptide
GRGNRNRGNRGSG

SEQ ID NO: 561 - protein, 13 aa, Artificial Sequence
  Synthetic Peptide
SGGRGNRNRGNRG

SEQ ID NO: 562 - protein, 13 aa, Artificial Sequence
  Synthetic Peptide
GYGSVGRMGMGNS

SEQ ID NO: 563 - protein, 13 aa, Artificial Sequence
  Synthetic Peptide
  misc_feature (11)..(13): Xaa can be any naturally occurring amino acid
MSGGGWRGMYXXX

SEQ ID NO: 564 - protein, 13 aa, Artificial Sequence
  Synthetic Peptide
MYDRMRRGGDGYD

SEQ ID NO: 565 - protein, 13 aa, Artificial Sequence
  Synthetic Peptide
GYYGAGRGSMYDR

SEQ ID NO: 566 - protein, 13 aa, Artificial Sequence
  Synthetic Peptide
DRPIGGRGGYYGA

SEQ ID NO: 567 - protein, 13 aa, Artificial Sequence
  Synthetic Peptide
RPGPYDRPIGGRG

SEQ ID NO: 568 - protein, 13 aa, Artificial Sequence
  Synthetic Peptide
YSYAGGRGSYGDL

SEQ ID NO: 569 - protein, 13 aa, Artificial Sequence
  Synthetic Peptide
PPPPPPRGGDLMA

SEQ ID NO: 570 - protein, 13 aa, Artificial Sequence
  Synthetic Peptide
LMAYDRRGRPGDR

SEQ ID NO: 571 - protein, 13 aa, Artificial Sequence
  Synthetic Peptide
MMFDDRRGRPVGF

SEQ ID NO: 572 - protein, 13 aa, Artificial Sequence
  Synthetic Peptide
PHYEGRRMGPPVG

SEQ ID NO: 573 - protein, 13 aa, Artificial Sequence
  Synthetic Peptide
YYHPPPRMPPPMR

SEQ ID NO: 574 - protein, 13 aa, Artificial Sequence
  Synthetic Peptide
RGGFQNRGGGGGS

SEQ ID NO: 575 - protein, 13 aa, Artificial Sequence
  Synthetic Peptide
GGGGNYRGGFNRS

SEQ ID NO: 576 - protein, 13 aa, Artificial Sequence
  Synthetic Peptide
YRGGFNRSGGGGY

SEQ ID NO: 577 - protein, 13 aa, Artificial Sequence
  Synthetic Peptide
NNNSNNRGNYNRA

SEQ ID NO: 578 - protein, 13 aa, Artificial Sequence
  Synthetic Peptide
DRDRYYRNYYGYQ

SEQ ID NO: 579 - protein, 13 aa, Artificial Sequence
  Synthetic Peptide
  misc_feature (8)..(13): Xaa can be any naturally occurring amino acid
YGYQGYRXXXXXX

SEQ ID NO: 580 - protein, 13 aa, Artificial Sequence
  Synthetic Peptide
NFYDRYRGDYERF

SEQ ID NO: 581 - protein, 13 aa, Artificial Sequence
  Synthetic Peptide
YYRQYNRDWQNYY

SEQ ID NO: 582 - protein, 13 aa, Artificial Sequence
  Synthetic Peptide
GVPEPSRGRGVSV

SEQ ID NO: 583 - protein, 13 aa, Artificial Sequence
  Synthetic Peptide
PEPSRGRGVSVRG

SEQ ID NO: 584 - protein, 13 aa, Artificial Sequence
  Synthetic Peptide
PPGGRGRGRGQGN

SEQ ID NO: 585 - protein, 13 aa, Artificial Sequence
  Synthetic Peptide
CGLVIGRGGENVK

SEQ ID NO: 586 - protein, 13 aa, Artificial Sequence
  Synthetic Peptide
GMPPGGRGRGRGQ

SEQ ID NO: 587 - protein, 13 aa, Artificial Sequence
  Synthetic Peptide
PPGAGDRGGGGPG

SEQ ID NO: 588 - protein, 13 aa, Artificial Sequence
  Synthetic Peptide
GDEDCQRGGQKKK

SEQ ID NO: 589 - protein, 13 aa, Artificial Sequence
  Synthetic Peptide
GGFGGGRGGFGGG

SEQ ID NO: 590 - protein, 13 aa, Artificial Sequence
  Synthetic Peptide
GPGSNFRGGSDGY

SEQ ID NO: 591 - protein, 13 aa, Artificial Sequence
  Synthetic Peptide
DGYGSGRGFGDGY

SEQ ID NO: 592 - protein, 13 aa, Artificial Sequence
  Synthetic Peptide
  misc_feature (11)..(13): Xaa can be any naturally occurring amino acid
SGGYGGRSRYXXX

SEQ ID NO: 593 - protein, 13 aa, Artificial Sequence
  Synthetic Peptide
QEVQSSRSGRGGN

SEQ ID NO: 594 - protein, 13 aa, Artificial Sequence
  Synthetic Peptide
PKRAVAREESGKP

SEQ ID NO: 595 - protein, 13 aa, Artificial Sequence
  Synthetic Peptide
GNFGGSRNMGGPY

SEQ ID NO: 596 - protein, 13 aa, Artificial Sequence
  Synthetic Peptide
TTEESLRNYYEQW

SEQ ID NO: 597 - protein, 13 aa, Artificial Sequence
  Synthetic Peptide
TESAMEREKEQFR

SEQ ID NO: 598 - protein, 13 aa, Artificial Sequence
  Synthetic Peptide
SPTGSARGRSRVM

SEQ ID NO: 599 - protein, 13 aa, Artificial Sequence
  Synthetic Peptide
FVATYGRGYPGFA

SEQ ID NO: 600 - protein, 13 aa, Artificial Sequence
  Synthetic Peptide
AAVAAARGSVLNS

SEQ ID NO: 601 - protein, 13 aa, Artificial Sequence
  Synthetic Peptide
MFPPGTRGRARGL

SEQ ID NO: 602 - protein, 13 aa, Artificial Sequence
  Synthetic Peptide
EDYDAGRGGYGKL

SEQ ID NO: 603 - protein, 13 aa, Artificial Sequence
  Synthetic Peptide
SQTGWPRGVNQFG

SEQ ID NO: 604 - protein, 13 aa, Artificial Sequence
  Synthetic Peptide
AATPAVRTVPQYK

SEQ ID NO: 605 - protein, 13 aa, Artificial Sequence
  Synthetic Peptide
ASSQVPRVMSTQR

SEQ ID NO: 606 - protein, 13 aa, Artificial Sequence
  Synthetic Peptide
QLRPSPRWTAQGA

SEQ ID NO: 607 - protein, 13 aa, Artificial Sequence
  Synthetic Peptide
VPQAQGRPPYYTP

SEQ ID NO: 608 - protein, 13 aa, Artificial Sequence
  Synthetic Peptide
RWQQGGRPQGFQG

SEQ ID NO: 609 - protein, 13 aa, Artificial Sequence
  Synthetic Peptide
GMPSALRQSGPRP

SEQ ID NO: 610 - protein, 13 aa, Artificial Sequence
  Synthetic Peptide
TNQYMQRVAGMRA

SEQ ID NO: 611 - protein, 13 aa, Artificial Sequence
  Synthetic Peptide
AGAAGGRGSGPGR

SEQ ID NO: 612 - protein, 13 aa, Artificial Sequence
  Synthetic Peptide
YHQEIARSSYADM

SEQ ID NO: 613 - protein, 13 aa, Artificial Sequence
  Synthetic Peptide
PGTGAERGGLMVS

SEQ ID NO: 614 - protein, 13 aa, Artificial Sequence
  Synthetic Peptide
  misc_feature (1)..(5): Xaa can be any naturally occurring amino acid
XXXXXMRPGTGAE

SEQ ID NO: 615 - protein, 13 aa, Artificial Sequence
  Synthetic Peptide
ADGFLRRRPSMGH

SEQ ID NO: 616 - protein, 13 aa, Artificial Sequence
  Synthetic Peptide
FRGDDGRGGGSGG

SEQ ID NO: 617 - protein, 13 aa, Artificial Sequence
  Synthetic Peptide
AGRKPARGGQGPP

SEQ ID NO: 618 - protein, 13 aa, Artificial Sequence
  Synthetic Peptide
PRLLQGRPPLDFY

SEQ ID NO: 619 - protein, 13 aa, Artificial Sequence
  Synthetic Peptide
LQASIYRGGYNRF

SEQ ID NO: 620 - protein, 13 aa, Artificial Sequence
  Synthetic Peptide
LTDAKTRSHADDV

SEQ ID NO: 621 - protein, 13 aa, Artificial Sequence
  Synthetic Peptide
  misc_feature (12)..(13): Xaa can be any naturally occurring amino acid
YRGGYNRFAPYXX

SEQ ID NO: 622 - protein, 13 aa, Artificial Sequence
  Synthetic Peptide
TTAAAFRGAHLRG

SEQ ID NO: 623 - protein, 13 aa, Artificial Sequence
  Synthetic Peptide
FRGAHLRGRGRTV

SEQ ID NO: 624 - protein, 13 aa, Artificial Sequence
  Synthetic Peptide
AVASLYRGGYSRF

SEQ ID NO: 625 - protein, 13 aa, Artificial Sequence
  Synthetic Peptide
TTAAAFRGAHLRG

SEQ ID NO: 626 - protein, 13 aa, Artificial Sequence
  Synthetic Peptide
GPGAAARGMKRES

SEQ ID NO: 627 - protein, 13 aa, Artificial Sequence
  Synthetic Peptide
  misc_feature (12)..(13): Xaa can be any naturally occurring amino acid
YRGGYSRFAPYXX

SEQ ID NO: 628 - protein, 13 aa, Artificial Sequence
  Synthetic Peptide
GTAVAYRGAHLRG

SEQ ID NO: 629 - protein, 13 aa, Artificial Sequence
  Synthetic Peptide
GSGLGARGSSYGV

SEQ ID NO: 630 - protein, 13 aa, Artificial Sequence
  Synthetic Peptide
SGRYDSRPGGYGY

SEQ ID NO: 631 - protein, 13 aa, Artificial Sequence
  Synthetic Peptide
YGYGYGRSRDYSG

SEQ ID NO: 632 - protein, 13 aa, Artificial Sequence
  Synthetic Peptide
RETQRSRGFGFIT

SEQ ID NO: 633 - protein, 13 aa, Artificial Sequence
  Synthetic Peptide
KSARGSRGGAFGG

SEQ ID NO: 634 - protein, 13 aa, Artificial Sequence
  Synthetic Peptide
PGGGTGRLAALFS

SEQ ID NO: 635 - protein, 13 aa, Artificial Sequence
  Synthetic Peptide
NRTPGPRGSYLGG

SEQ ID NO: 636 - protein, 13 aa, Artificial Sequence
  Synthetic Peptide
GGPPPKRSAPSGP

SEQ ID NO: 637 - protein, 13 aa, Artificial Sequence
  Synthetic Peptide
FTMSSSRGPLPVK

SEQ ID NO: 638 - protein, 13 aa, Artificial Sequence
  Synthetic Peptide
SFESGRRGLPPPP

SEQ ID NO: 639 - protein, 13 aa, Artificial Sequence
  Synthetic Peptide
GLPPPPRSRGPPR

SEQ ID NO: 640 - protein, 13 aa, Artificial Sequence
  Synthetic Peptide
FNMSSSRGPLPVK

SEQ ID NO: 641 - protein, 13 aa, Artificial Sequence
  Synthetic Peptide
GGPPPKRSTPSGP

SEQ ID NO: 642 - protein, 13 aa, Artificial Sequence
  Synthetic Peptide
TPSGPVRSSSGMG

SEQ ID NO: 643 - protein, 13 aa, Artificial Sequence
  Synthetic Peptide
GPPRGLRGGSGGT

SEQ ID NO: 644 - protein, 13 aa, Artificial Sequence
  Synthetic Peptide
RSAPPTRGPPPSY

SEQ ID NO: 645 - protein, 13 aa, Artificial Sequence
  Synthetic Peptide
YRQQRNRGFGQSN

SEQ ID NO: 646 - protein, 13 aa, Artificial Sequence
  Synthetic Peptide
ASSWAVRKTLPAD

SEQ ID NO: 647 - protein, 13 aa, Artificial Sequence
  Synthetic Peptide
GDGFDSRGKREFD

SEQ ID NO: 648 - protein, 13 aa, Artificial Sequence
  Synthetic Peptide
LKHEDKRGGSGSH

SEQ ID NO: 649 - protein, 13 aa, Artificial Sequence
  Synthetic Peptide
NFGDLGRPGRGGR

SEQ ID NO: 650 - protein, 13 aa, Artificial Sequence
  Synthetic Peptide
DLGRPGRGGRGGR

SEQ ID NO: 651 - protein, 13 aa, Artificial Sequence
  Synthetic Peptide
RPGRGGRGGRGGR

SEQ ID NO: 652 - protein, 13 aa, Artificial Sequence
  Synthetic Peptide
RGRGMGRGDGFDS

SEQ ID NO: 653 - protein, 13 aa, Artificial Sequence
  Synthetic Peptide
ERPIRGRGGLGRG

SEQ ID NO: 654 - protein, 13 aa, Artificial Sequence
  Synthetic Peptide
DRPIIERPIRGRG

SEQ ID NO: 655 - protein, 13 aa, Artificial Sequence
  Synthetic Peptide
TMISTMRPDIDNM

SEQ ID NO: 656 - protein, 13 aa, Artificial Sequence
  Synthetic Peptide
GLGGTRRGGADVN

SEQ ID NO: 657 - protein, 13 aa, Artificial Sequence
  Synthetic Peptide
TQYPPGRGTPPPP

SEQ ID NO: 658 - protein, 13 aa, Artificial Sequence
  Synthetic Peptide
NLVVGPRSAHGTA

SEQ ID NO: 659 - protein, 13 aa, Artificial Sequence
  Synthetic Peptide
ISLGTARPPPSMS

SEQ ID NO: 660 - protein, 13 aa, Artificial Sequence
  Synthetic Peptide
AAGLAARMSQVPA

SEQ ID NO: 661 - protein, 13 aa, Artificial Sequence
  Synthetic Peptide
VNLADPRTPAASA

SEQ ID NO: 662 - protein, 13 aa, Artificial Sequence
  Synthetic Peptide
REWDRGRERRSRG

SEQ ID NO: 663 - protein, 13 aa, Artificial Sequence
  Synthetic Peptide
GGAPRGRYGPPSR

SEQ ID NO: 664 - protein, 13 aa, Artificial Sequence
  Synthetic Peptide
IDLKNRRGGPPFA

SEQ ID NO: 665 - protein, 13 aa, Artificial Sequence
  Synthetic Peptide
DFQVGARGRGGRG

SEQ ID NO: 666 - protein, 13 aa, Artificial Sequence
  Synthetic Peptide
GSQGGGRGRGGYD

SEQ ID NO: 667 - protein, 13 aa, Artificial Sequence
  Synthetic Peptide
QGGGRGRGGYDKD

SEQ ID NO: 668 - protein, 13 aa, Artificial Sequence
  Synthetic Peptide
GGFGNSRGGGAGL

SEQ ID NO: 669 - protein, 13 aa, Artificial Sequence
  Synthetic Peptide
GILAWGRGSGTNG

SEQ ID NO: 670 - protein, 13 aa, Artificial Sequence
  Synthetic Peptide
GGGGGGRRRDSYY

SEQ ID NO: 671 - protein, 13 aa, Artificial Sequence
  Synthetic Peptide
EMGECTRGGFCNF

SEQ ID NO: 672 - protein, 13 aa, Artificial Sequence
  Synthetic Peptide
PLLPWNRMIQNQN

SEQ ID NO: 673 - protein, 13 aa, Artificial Sequence
  Synthetic Peptide
RGRYSDRFSSRRP

SEQ ID NO: 674 - protein, 13 aa, Artificial Sequence
  Synthetic Peptide
GGNFSGRGGFGGR

SEQ ID NO: 675 - protein, 13 aa, Artificial Sequence
  Synthetic Peptide
RGGFGGRRGGGGY

SEQ ID NO: 676 - protein, 13 aa, Artificial Sequence
  Synthetic Peptide
LNGTGDRGGHQSS

SEQ ID NO: 677 - protein, 13 aa, Artificial Sequence
  Synthetic Peptide
GRPLPERRWLKAG

SEQ ID NO: 678 - protein, 13 aa, Artificial Sequence
  Synthetic Peptide
RPLPERRWLKAGS

SEQ ID NO: 679 - protein, 13 aa, Artificial Sequence
  Synthetic Peptide
CVILAGRPLPERR

SEQ ID NO: 680 - protein, 13 aa, Artificial Sequence
  Synthetic Peptide
TCWAENRVGRVQA

SEQ ID NO: 681 - protein, 13 aa, Artificial Sequence
  Synthetic Peptide
AENRVGRVQAVSF

SEQ ID NO: 682 - protein, 13 aa, Artificial Sequence
  Synthetic Peptide
IIVTDGRPQDQVN

SEQ ID NO: 683 - protein, 13 aa, Artificial Sequence
  Synthetic Peptide
IPGPRRRAGPRRR

SEQ ID NO: 684 - protein, 13 aa, Artificial Sequence
  Synthetic Peptide
LSPSHPRPATRLR

SEQ ID NO: 685 - protein, 13 aa, Artificial Sequence
  Synthetic Peptide
HPRPATRLRLDRT

SEQ ID NO: 686 - protein, 13 aa, Artificial Sequence
  Synthetic Peptide
RPATRLRLDRTQP

SEQ ID NO: 687 - protein, 13 aa, Artificial Sequence
  Synthetic Peptide
ALQYSCRLQNLDG

SEQ ID NO: 688 - protein, 13 aa, Artificial Sequence
  Synthetic Peptide
GGDPGWRQRSRLC

SEQ ID NO: 689 - protein, 13 aa, Artificial Sequence
  Synthetic Peptide
DPGWRQRSRLCPS

SEQ ID NO: 690 - protein, 13 aa, Artificial Sequence
  Synthetic Peptide
GWRQRSRLCPSSR

SEQ ID NO: 691 - protein, 13 aa, Artificial Sequence
  Synthetic Peptide
AAFGNSRAQDVQD

SEQ ID NO: 692 - protein, 13 aa, Artificial Sequence
  Synthetic Peptide
LQPAEGRLDTRPF

SEQ ID NO: 693 - protein, 13 aa, Artificial Sequence
  Synthetic Peptide
HYSAERRRLGPHV

SEQ ID NO: 694 - protein, 13 aa, Artificial Sequence
  Synthetic Peptide
YSAERRRLGPHVC

SEQ ID NO: 695 - protein, 13 aa, Artificial Sequence
  Synthetic Peptide
AGAMPARGGKRRS

SEQ ID NO: 696 - protein, 13 aa, Artificial Sequence
  Synthetic Peptide
RLVSELRWPIPGP

SEQ ID NO: 697 - protein, 13 aa, Artificial Sequence
  Synthetic Peptide
IPGSVSREASGLA

SEQ ID NO: 698 - protein, 13 aa, Artificial Sequence
  Synthetic Peptide
NPFNLLRMTGPIL

SEQ ID NO: 699 - protein, 13 aa, Artificial Sequence
  Synthetic Peptide
RGRGRARGGWPGA

SEQ ID NO: 700 - protein, 13 aa, Artificial Sequence
  Synthetic Peptide
MAGSPSRGGIWQS

SEQ ID NO: 701 - protein, 13 aa, Artificial Sequence
  Synthetic Peptide
APSMSVRGGGAGQ

SEQ ID NO: 702 - protein, 13 aa, Artificial Sequence
  Synthetic Peptide
ALGLPMRGMSNNT

SEQ ID NO: 703 - protein, 13 aa, Artificial Sequence
  Synthetic Peptide
HHGLVDRVYRERG

SEQ ID NO: 704 - protein, 13 aa, Artificial Sequence
  Synthetic Peptide
PNQPSARRGFRRP

SEQ ID NO: 705 - protein, 13 aa, Artificial Sequence
  Synthetic Peptide
GSRIWERGGGIAP

SEQ ID NO: 706 - protein, 13 aa, Artificial Sequence
  Synthetic Peptide
QFSGIGRSGQQPQ

SEQ ID NO: 707 - protein, 13 aa, Artificial Sequence
  Synthetic Peptide
MQLVDHRGGGGGG

SEQ ID NO: 708 - protein, 13 aa, Artificial Sequence
  Synthetic Peptide
  misc_feature (1)..(5): Xaa can be any naturally occurring amino acid
XXXXXMRGGGFGD

SEQ ID NO: 709 - protein, 13 aa, Artificial Sequence
  Synthetic Peptide
GDRDRDRDRGGFG

SEQ ID NO: 710 - protein, 13 aa, Artificial Sequence
  Synthetic Peptide
SGRSRGRGGMKDD

SEQ ID NO: 711 - protein, 13 aa, Artificial Sequence
  Synthetic Peptide
RGSGRSRGRGGMK

SEQ ID NO: 712 - protein, 13 aa, Artificial Sequence
  Synthetic Peptide
SYLGGPRGGAPAQ

SEQ ID NO: 713 - protein, 13 aa, Artificial Sequence
  Synthetic Peptide
FPQPGQRGGGPQP

SEQ ID NO: 714 - protein, 13 aa, Artificial Sequence
  Synthetic Peptide
APAAAARGGRVAA

SEQ ID NO: 715 - protein, 13 aa, Artificial Sequence
  Synthetic Peptide
SKTFLSRHSMDMK

SEQ ID NO: 716 - protein, 13 aa, Artificial Sequence
  Synthetic Peptide
PGGPMGRMGGRGG

SEQ ID NO: 717 - protein, 13 aa, Artificial Sequence
  Synthetic Peptide
ETIMTLRTSPPGG

SEQ ID NO: 718 - protein, 13 aa, Artificial Sequence
  Synthetic Peptide
LSPAAARAGLVVP

SEQ ID NO: 719 - protein, 13 aa, Artificial Sequence
  Synthetic Peptide
EPHFYLRCLGKNG

SEQ ID NO: 720 - protein, 13 aa, Artificial Sequence
  Synthetic Peptide
GPGPGGRGRGRGQ

SEQ ID NO: 721 - protein, 13 aa, Artificial Sequence
  Synthetic Peptide
DGTTPDRIAQITG

SEQ ID NO: 722 - protein, 13 aa, Artificial Sequence
  Synthetic Peptide
QNTFPPRGFPNIA

SEQ ID NO: 723 - protein, 13 aa, Artificial Sequence
  Synthetic Peptide
LRIFTIRGAPQQM

SEQ ID NO: 724 - protein, 13 aa, Artificial Sequence
  Synthetic Peptide
GRGGGDRGGFGPG

SEQ ID NO: 725 - protein, 13 aa, Artificial Sequence
  Synthetic Peptide
VMPPLVRGAQIHN

SEQ ID NO: 726 - protein, 13 aa, Artificial Sequence
  Synthetic Peptide
IPPPLVRGGQQVS

SEQ ID NO: 727 - protein, 13 aa, Artificial Sequence
  Synthetic Peptide
PDLPFIRISPHRN

SEQ ID NO: 728 - protein, 13 aa, Artificial Sequence
  Synthetic Peptide
SLPASVRMVVPTQ

SEQ ID NO: 729 - protein, 13 aa, Artificial Sequence
  Synthetic Peptide
GKYCHLRGGGSGG

SEQ ID NO: 730 - protein, 13 aa, Artificial Sequence
  Synthetic Peptide
GGRFGSRGGPGGG

SEQ ID NO: 731 - protein, 13 aa, Artificial Sequence
  Synthetic Peptide
AYSYCGRGFYPQY

SEQ ID NO: 732 - protein, 13 aa, Artificial Sequence
  Synthetic Peptide
VAVGVPRGTPTPR

SEQ ID NO: 733 - protein, 13 aa, Artificial Sequence
  Synthetic Peptide
DFTVTGRGSPSRR

SEQ ID NO: 734 - protein, 13 aa, Artificial Sequence
  Synthetic Peptide
DVGEERRGGGGTD

SEQ ID NO: 735 - protein, 13 aa, Artificial Sequence
  Synthetic Peptide
RMGELYRGAMTSS

SEQ ID NO: 736 - protein, 13 aa, Artificial Sequence
  Synthetic Peptide
GDIGLSRGFGDSF

SEQ ID NO: 737 - protein, 13 aa, Artificial Sequence
  Synthetic Peptide
MERDFGRGDIGLS

SEQ ID NO: 738 - protein, 13 aa, Artificial Sequence
  Synthetic Peptide
GTPTVLRWARSTS

SEQ ID NO: 739 - protein, 13 aa, Artificial Sequence
  Synthetic Peptide
DPTSIPRGIPLEA

SEQ ID NO: 740 - protein, 13 aa, Artificial Sequence
  Synthetic Peptide
QRADMLRGLSPRE

SEQ ID NO: 741 - protein, 13 aa, Artificial Sequence
  Synthetic Peptide
RFPAISRFMGPAS

SEQ ID NO: 742 - protein, 13 aa, Artificial Sequence
  Synthetic Peptide
DLYKTLRGGATVK

SEQ ID NO: 743 - protein, 13 aa, Artificial Sequence
  Synthetic Peptide
SLLGRGRGSVMDL

SEQ ID NO: 744 - protein, 13 aa, Artificial Sequence
  Synthetic Peptide
YEGSAFRGGFRFN

SEQ ID NO: 745 - protein, 13 aa, Artificial Sequence
  Synthetic Peptide
TYSSLDRAPSPRP

SEQ ID NO: 746 - protein, 13 aa, Artificial Sequence
  Synthetic Peptide
DRAPSPRPRAFDG

SEQ ID NO: 747 - protein, 13 aa, Artificial Sequence
  Synthetic Peptide
APSPRPRAFDGAG

SEQ ID NO: 748 - protein, 13 aa, Artificial Sequence
  Synthetic Peptide
ERGPSPRPPAAAY

SEQ ID NO: 749 - protein, 13 aa, Artificial Sequence
  Synthetic Peptide
PGIGPVRQPGPST

SEQ ID NO: 750 - protein, 13 aa, Artificial Sequence
  Synthetic Peptide
GRAPSPRPGIGPV

SEQ ID NO: 751 - protein, 13 aa, Artificial Sequence
  Synthetic Peptide
AFTPPLRAQDDST

SEQ ID NO: 752 - protein, 13 aa, Artificial Sequence
  Synthetic Peptide
DWWWGERAGCCGY

SEQ ID NO: 753 - protein, 13 aa, Artificial Sequence
  Synthetic Peptide
VERVESRNGRGSS

SEQ ID NO: 754 - protein, 13 aa, Artificial Sequence
  Synthetic Peptide
VESRNGRGSSGGG

SEQ ID NO: 755 - protein, 13 aa, Artificial Sequence
  Synthetic Peptide
KRLSEGRGLPPPP

SEQ ID NO: 756 - protein, 13 aa, Artificial Sequence
  Synthetic Peptide
GHVAAGRGGMAGQ

SEQ ID NO: 757 - protein, 13 aa, Artificial Sequence
  Synthetic Peptide
TPAGYGRGREEYE

SEQ ID NO: 758 - protein, 13 aa, Artificial Sequence
  Synthetic Peptide
HPKPPHRGGGEPR

SEQ ID NO: 759 - protein, 13 aa, Artificial Sequence
  Synthetic Peptide
RGGGEPRGGRQHH

SEQ ID NO: 760 - protein, 13 aa, Artificial Sequence
  Synthetic Peptide
GEPRGGRQHHAPY

SEQ ID NO: 761 - protein, 13 aa, Artificial Sequence
  Synthetic Peptide
AGYGRGREEYEGP

SEQ ID NO: 762 - protein, 13 aa, Artificial Sequence
  Synthetic Peptide
SGGSAGRGFGGSR

SEQ ID NO: 763 - protein, 13 aa, Artificial Sequence
  Synthetic Peptide
SGNSLPRGSSSGF

SEQ ID NO: 764 - protein, 13 aa, Artificial Sequence
  Synthetic Peptide
AWKTKGRGAANDS

SEQ ID NO: 765 - protein, 13 aa, Artificial Sequence
  Synthetic Peptide
QTLVSARAAAPPQ

SEQ ID NO: 766 - protein, 13 aa, Artificial Sequence
  Synthetic Peptide
QDALVPRGPRGVR

SEQ ID NO: 767 - protein, 13 aa, Artificial Sequence
  Synthetic Peptide
LVPRGPRGVRGVR

SEQ ID NO: 768 - protein, 13 aa, Artificial Sequence
  Synthetic Peptide
GTSQWPRAGAPSA

SEQ ID NO: 769 - protein, 13 aa, Artificial Sequence
  Synthetic Peptide
RGGGPMRNRPAIA

SEQ ID NO: 770 - protein, 13 aa, Artificial Sequence
  Synthetic Peptide
AYQAAIRGVGSAQ

SEQ ID NO: 771 - protein, 13 aa, Artificial Sequence
  Synthetic Peptide
FALPSSRGGPGKL

SEQ ID NO: 772 - protein, 13 aa, Artificial Sequence
  Synthetic Peptide
SSGSSGRGAGPLK

SEQ ID NO: 773 - protein, 13 aa, Artificial Sequence
  Synthetic Peptide
AGSSNSRSLRLRE

SEQ ID NO: 774 - protein, 13 aa, Artificial Sequence
  Synthetic Peptide
FPVFPDRHLTPEV

SEQ ID NO: 775 - protein, 13 aa, Artificial Sequence
  Synthetic Peptide
FPPYYMRRPYARR

SEQ ID NO: 776 - protein, 13 aa, Artificial Sequence
  Synthetic Peptide
VRQNMYRGYRPRF

SEQ ID NO: 777 - protein, 13 aa, Artificial Sequence
  Synthetic Peptide
KWGTIPRGPASQF

SEQ ID NO: 778 - protein, 13 aa, Artificial Sequence
  Synthetic Peptide
SGRTRGRPSRSGG

SEQ ID NO: 779 - protein, 13 aa, Artificial Sequence
  Synthetic Peptide
TRGRPSRSGGTSA

SEQ ID NO: 780 - protein, 13 aa, Artificial Sequence
  Synthetic Peptide
GGCGSGRTRGRPS

SEQ ID NO: 781 - protein, 13 aa, Artificial Sequence
  Synthetic Peptide
YALYGQRLTTASA

SEQ ID NO: 782 - protein, 13 aa, Artificial Sequence
  Synthetic Peptide
HLSRHLRGHGPQP

SEQ ID NO: 783 - protein, 13 aa, Artificial Sequence
  Synthetic Peptide
PPAKSLRGGPGSG

SEQ ID NO: 784 - protein, 13 aa, Artificial Sequence
  Synthetic Peptide
GTQSSGRGGSLAR

SEQ ID NO: 785 - protein, 13 aa, Artificial Sequence
  Synthetic Peptide
RRGGRARGGQGPR

SEQ ID NO: 786 - protein, 13 aa, Artificial Sequence
  Synthetic Peptide
  misc_feature (1)..(1): Xaa can be any naturally occurring amino acid
XMARESRESTTLD

SEQ ID NO: 787 - protein, 13 aa, Artificial Sequence
  Synthetic Peptide
QQGVYGRGSYPGG

SEQ ID NO: 788 - protein, 13 aa, Artificial Sequence
  Synthetic Peptide
RSSGGGRGGGAGG

SEQ ID NO: 789 - protein, 13 aa, Artificial Sequence
  Synthetic Peptide
FPSYSLRLPSVTG

SEQ ID NO: 790 - protein, 13 aa, Artificial Sequence
  Synthetic Peptide
KRSRAGRGETTKP

SEQ ID NO: 791 - protein, 13 aa, Artificial Sequence
  Synthetic Peptide
AGRASKRGGGGSG

SEQ ID NO: 792 - protein, 13 aa, Artificial Sequence
  Synthetic Peptide
LSELSRRRIRSIN

SEQ ID NO: 793 - protein, 13 aa, Artificial Sequence
  Synthetic Peptide
SELSRRRIRSINK

SEQ ID NO: 794 - protein, 13 aa, Artificial Sequence
  Synthetic Peptide
RAPPIDRSILPTA

SEQ ID NO: 795 - protein, 13 aa, Artificial Sequence
  Synthetic Peptide
RRDDDYRGGGDRY

SEQ ID NO: 796 - protein, 13 aa, Artificial Sequence
  Synthetic Peptide
PGPPINRGLPLVD

SEQ ID NO: 797 - protein, 13 aa, Artificial Sequence
  Synthetic Peptide
YIPGQGRSTYVVP

SEQ ID NO: 798 - protein, 13 aa, Artificial Sequence
  Synthetic Peptide
QHFYPSRAQPPSS

SEQ ID NO: 799 - protein, 13 aa, Artificial Sequence
  Synthetic Peptide
PSSAASRVQSAAP

SEQ ID NO: 800 - protein, 13 aa, Artificial Sequence
  Synthetic Peptide
SNRGPPRGGPGGE

SEQ ID NO: 801 - protein, 13 aa, Artificial Sequence
  Synthetic Peptide
KGSDKRRGGPPGP

SEQ ID NO: 802 - protein, 13 aa, Artificial Sequence
  Synthetic Peptide
PGGELPRGPAGLG

SEQ ID NO: 803 - protein, 13 aa, Artificial Sequence
  Synthetic Peptide
PTPEPPRTSSPTS

SEQ ID NO: 804 - protein, 13 aa, Artificial Sequence
  Synthetic Peptide
SRPGDRRAGPPMG

SEQ ID NO: 805 - protein, 13 aa, Artificial Sequence
  Synthetic Peptide
RDGPPLRGSNMDF

SEQ ID NO: 806 - protein, 13 aa, Artificial Sequence
  Synthetic Peptide
GGGRGSRGSAGGH

SEQ ID NO: 807 - protein, 13 aa, Artificial Sequence
  Synthetic Peptide
DGQGMGRGSRPYR

SEQ ID NO: 808 - protein, 13 aa, Artificial Sequence
  Synthetic Peptide
GMGRGSRPYRNRG

SEQ ID NO: 809 - protein, 13 aa, Artificial Sequence
  Synthetic Peptide
TFGVSGRFLRGRS

SEQ ID NO: 810 - protein, 13 aa, Artificial Sequence
  Synthetic Peptide
  misc_feature (9)..(13): Xaa can be any naturally occurring amino acid
HRAGTGRVXXXXX

SEQ ID NO: 811 - protein, 13 aa, Artificial Sequence
  Synthetic Peptide
AFGNMCRGGRMFA

SEQ ID NO: 812 - protein, 13 aa, Artificial Sequence
  Synthetic Peptide
ATEFQFRGGFGRG

SEQ ID NO: 813 - protein, 13 aa, Artificial Sequence
  Synthetic Peptide
TGNVSIRGRILSG

SEQ ID NO: 814 - protein, 13 aa, Artificial Sequence
  Synthetic Peptide
GFHWVPRDAQDAL

SEQ ID NO: 815 - protein, 13 aa, Artificial Sequence
  Synthetic Peptide
QDALVPRGQRGVR

SEQ ID NO: 816 - protein, 13 aa, Artificial Sequence
  Synthetic Peptide
LVPRGQRGVRGVR

SEQ ID NO: 817 - protein, 13 aa, Artificial Sequence
  Synthetic Peptide
LYWSHPRKFGQGS

SEQ ID NO: 818 - protein, 13 aa, Artificial Sequence
  Synthetic Peptide
GGRGGFRGGFGSG

SEQ ID NO: 819 - protein, 13 aa, Artificial Sequence
  Synthetic Peptide
GFGSGIRGRGCGQ

SEQ ID NO: 820 - protein, 13 aa, Artificial Sequence
  Synthetic Peptide
GSGIRGRGCGQGR

SEQ ID NO: 821 - protein, 13 aa, Artificial Sequence
  Synthetic Peptide
HSSPLERGGIHSN

SEQ ID NO: 822 - protein, 13 aa, Artificial Sequence
  Synthetic Peptide
PIPVYPRAYLPTS

SEQ ID NO: 823 - protein, 13 aa, Artificial Sequence
  Synthetic Peptide
GGEYDERPILPSV

SEQ ID NO: 824 - protein, 13 aa, Artificial Sequence
  Synthetic Peptide
PGMTSPRFIEFVC

SEQ ID NO: 825 - protein, 13 aa, Artificial Sequence
  Synthetic Peptide
SSATLKRGGKKCA

SEQ ID NO: 826 - protein, 13 aa, Artificial Sequence
  Synthetic Peptide
TRLAVQRGGTFQM

SEQ ID NO: 827 - protein, 13 aa, Artificial Sequence
  Synthetic Peptide
NPYLPTRGGTTVA

SEQ ID NO: 828 - protein, 13 aa, Artificial Sequence
  Synthetic Peptide
NYFSGSRGSVQGM

SEQ ID NO: 829 - protein, 13 aa, Artificial Sequence
  Synthetic Peptide
IADYFGRGVFNKL

SEQ ID NO: 830 - protein, 13 aa, Artificial Sequence
  Synthetic Peptide
GGGNFGRGGHFGG

SEQ ID NO: 831 - protein, 13 aa, Artificial Sequence
  Synthetic Peptide
TLGGGGRGGGGGG

SEQ ID NO: 832 - protein, 13 aa, Artificial Sequence
  Synthetic Peptide
  misc_feature (1)..(3): Xaa can be any naturally occurring amino acid
XXXMGRRGGDTGS

SEQ ID NO: 833 - protein, 13 aa, Artificial Sequence
  Synthetic Peptide
AGSSGGRGGAGGP

SEQ ID NO: 834 - protein, 13 aa, Artificial Sequence
  Synthetic Peptide
SYYAITRGRRYYG

SEQ ID NO: 835 - protein, 13 aa, Artificial Sequence
  Synthetic Peptide
SLGNISRGGSGGN

SEQ ID NO: 836 - protein, 13 aa, Artificial Sequence
  Synthetic Peptide
GAPRITRGSAPLP

SEQ ID NO: 837 - protein, 13 aa, Artificial Sequence
  Synthetic Peptide
SRSSRSRGSFGMQ

SEQ ID NO: 838 - protein, 13 aa, Artificial Sequence
  Synthetic Peptide
HPATAARAAAPFP

SEQ ID NO: 839 - protein, 13 aa, Artificial Sequence
  Synthetic Peptide
FARSEIRLPGALA

SEQ ID NO: 840 - protein, 13 aa, Artificial Sequence
  Synthetic Peptide
LWVAPGRGAGAQP

SEQ ID NO: 841 - protein, 13 aa, Artificial Sequence
  Synthetic Peptide
NAELRGRGWGQQD

SEQ ID NO: 842 - protein, 13 aa, Artificial Sequence
  Synthetic Peptide
SPGAAARARKSTL

SEQ ID NO: 843 - protein, 13 aa, Artificial Sequence
  Synthetic Peptide
QLNAELRGRGWGQ

SEQ ID NO: 844 - protein, 13 aa, Artificial Sequence
  Synthetic Peptide
KKPRSTRGPRPDL

SEQ ID NO: 845 - protein, 13 aa, Artificial Sequence
  Synthetic Peptide
GGLSGSRGGGGGG

SEQ ID NO: 846 - protein, 13 aa, Artificial Sequence
  Synthetic Peptide
LLSSHVRGVGTRG

SEQ ID NO: 847 - protein, 13 aa, Artificial Sequence
  Synthetic Peptide
AYAAHMRGARHQK

SEQ ID NO: 848 - protein, 13 aa, Artificial Sequence
  Synthetic Peptide
EQQFGVRLDRRNA

SEQ ID NO: 849 - protein, 13 aa, Artificial Sequence
  Synthetic Peptide
FGVRLDRRNAKTL

SEQ ID NO: 850 - protein, 13 aa, Artificial Sequence
  Synthetic Peptide
GPHATCRGGSRCS

SEQ ID NO: 851 - protein, 13 aa, Artificial Sequence
  Synthetic Peptide
GAAPALRGSRSPN

SEQ ID NO: 852 - protein, 13 aa, Artificial Sequence
  Synthetic Peptide
RLALGSRGGYNGR

SEQ ID NO: 853 - protein, 13 aa, Artificial Sequence
  Synthetic Peptide
LSRRPLRGGWAPT

SEQ ID NO: 854 - protein, 13 aa, Artificial Sequence
  Synthetic Peptide
YGNSGFRPLNCGV

SEQ ID NO: 855 - protein, 13 aa, Artificial Sequence
  Synthetic Peptide
SLSYGSRYCSPIY

SEQ ID NO: 856 - protein, 13 aa, Artificial Sequence
  Synthetic Peptide
RTAAGSRGGSAAW

SEQ ID NO: 857 - protein, 13 aa, Artificial Sequence
  Synthetic Peptide
PRLPQPRILKHLP

SEQ ID NO: 858 - protein, 13 aa, Artificial Sequence
  Synthetic Peptide
APTTGGRGKQAEK

SEQ ID NO: 859 - protein, 13 aa, Artificial Sequence
  Synthetic Peptide
SRSGGGRGGPGPA

SEQ ID NO: 860 - protein, 13 aa, Artificial Sequence
  Synthetic Peptide
PAVTSARGRRLPP

SEQ ID NO: 861 - protein, 13 aa, Artificial Sequence
  Synthetic Peptide
  misc_feature (11)..(13): Xaa can be any naturally occurring amino acid
GASALPRGGKXXX

SEQ ID NO: 862 - protein, 13 aa, Artificial Sequence
  Synthetic Peptide
ARCAHPRGGVIQS

SEQ ID NO: 863 - protein, 13 aa, Artificial Sequence
  Synthetic Peptide
SLDGKCRGGQSGR

SEQ ID NO: 864 - protein, 13 aa, Artificial Sequence
  Synthetic Peptide
PGFSRFRGTQYPE

SEQ ID NO: 865 - protein, 13 aa, Artificial Sequence
  Synthetic Peptide
AVAGAGRGGGGGG

SEQ ID NO: 866 - protein, 13 aa, Artificial Sequence
  Synthetic Peptide
GHTAVLRTLLQAA

SEQ ID NO: 867 - protein, 13 aa, Artificial Sequence
  Synthetic Peptide
GDSPAARGGGRWR

SEQ ID NO: 868 - protein, 13 aa, Artificial Sequence
  Synthetic Peptide
APRPGVRGAPSSP

SEQ ID NO: 869 - protein, 13 aa, Artificial Sequence
  Synthetic Peptide
ASRGAPRLPTVCG

SEQ ID NO: 870 - protein, 13 aa, Artificial Sequence
  Synthetic Peptide
GAGEQLRGGPGGR

SEQ ID NO: 871 - protein, 13 aa, Artificial Sequence
  Synthetic Peptide
RGGPGGRGRRGRG

SEQ ID NO: 872 - protein, 13 aa, Artificial Sequence
  Synthetic Peptide
GPGGRGRRGRGRG

SEQ ID NO: 873 - protein, 13 aa, Artificial Sequence
  Synthetic Peptide
YISALLRRRRRRG

SEQ ID NO: 874 - protein, 13 aa, Artificial Sequence
  Synthetic Peptide
EPTGYIRFEKFIP

SEQ ID NO: 875 - protein, 13 aa, Artificial Sequence
  Synthetic Peptide
LASSGPRLVFNRV

SEQ ID NO: 876 - protein, 13 aa, Artificial Sequence
  Synthetic Peptide
SGPPVERPPLATD

SEQ ID NO: 877 - protein, 13 aa, Artificial Sequence
  Synthetic Peptide
LTVPGPRHVALSR

SEQ ID NO: 878 - protein, 13 aa, Artificial Sequence
  Synthetic Peptide
PRPSPRRGGSYYA

SEQ ID NO: 879 - protein, 13 aa, Artificial Sequence
  Synthetic Peptide
LAPGPRREDPLGR

SEQ ID NO: 880 - protein, 13 aa, Artificial Sequence
  Synthetic Peptide
PVLKTWRLVHTGP

SEQ ID NO: 881 - protein, 13 aa, Artificial Sequence
  Synthetic Peptide
IADQVSREYGGEG

SEQ ID NO: 882 - protein, 13 aa, Artificial Sequence
  Synthetic Peptide
PWKRGTRGGNLVT

SEQ ID NO: 883 - protein, 13 aa, Artificial Sequence
  Synthetic Peptide
RGSPWKRGTRGGN

SEQ ID NO: 884 - protein, 13 aa, Artificial Sequence
  Synthetic Peptide
ICSLEIRKPSPFD

SEQ ID NO: 885 - protein, 13 aa, Artificial Sequence
  Synthetic Peptide
TFLARGRGSTISE

SEQ ID NO: 886 - protein, 13 aa, Artificial Sequence
  Synthetic Peptide
NEGQTERPSYHPV

SEQ ID NO: 887 - protein, 13 aa, Artificial Sequence
  Synthetic Peptide
KPTPLPRKRAEVR

SEQ ID NO: 888 - protein, 13 aa, Artificial Sequence
  Synthetic Peptide
SLTLGARGRRTRS

SEQ ID NO: 889 - protein, 13 aa, Artificial Sequence
  Synthetic Peptide
TGVLGSRGMYSSG

SEQ ID NO: 890 - protein, 13 aa, Artificial Sequence
  Synthetic Peptide
GGRGQARSRGRGF

SEQ ID NO: 891 - protein, 13 aa, Artificial Sequence
  Synthetic Peptide
YIARDTRRLGATI

SEQ ID NO: 892 - protein, 13 aa, Artificial Sequence
  Synthetic Peptide
FANYIARDTRRLG

SEQ ID NO: 893 - protein, 13 aa, Artificial Sequence
  Synthetic Peptide
MRSGLPRPSAPSA

SEQ ID NO: 894 - protein, 13 aa, Artificial Sequence
  Synthetic Peptide
GGIPVPRSKLVQP

SEQ ID NO: 895 - protein, 13 aa, Artificial Sequence
  Synthetic Peptide
FGDSLARGGKGFL

SEQ ID NO: 896 - protein, 13 aa, Artificial Sequence
  Synthetic Peptide
HRRSVSRGSYQLQ

SEQ ID NO: 897 - protein, 13 aa, Artificial Sequence
  Synthetic Peptide
PVAGPGRGGRVGT

SEQ ID NO: 898 - protein, 13 aa, Artificial Sequence
  Synthetic Peptide
PNSIPLRGQVKGN

SEQ ID NO: 899 - protein, 13 aa, Artificial Sequence
  Synthetic Peptide
VQATSNRPHLSEA

SEQ ID NO: 900 - protein, 13 aa, Artificial Sequence
  Synthetic Peptide
LSGLLPRAVPQGP

SEQ ID NO: 901 - protein, 13 aa, Artificial Sequence
  Synthetic Peptide
LTLNQLRLSPVPP

SEQ ID NO: 902 - protein, 13 aa, Artificial Sequence
  Synthetic Peptide
NQITFGRGSSQPN

SEQ ID NO: 903 - protein, 13 aa, Artificial Sequence
  Synthetic Peptide
TARPGSRGGPLGT

SEQ ID NO: 904 - protein, 13 aa, Artificial Sequence
  Synthetic Peptide
LTSAPGRGSHGPP

SEQ ID NO: 905 - protein, 13 aa, Artificial Sequence
  Synthetic Peptide
VGVGRGRFTTYEI

SEQ ID NO: 906 - protein, 13 aa, Artificial Sequence
  Synthetic Peptide
PPQGGPRQAQSPQ

SEQ ID NO: 907 - protein, 13 aa, Artificial Sequence
  Synthetic Peptide
KLTDLQRSLEKFA

SEQ ID NO: 908 - protein, 13 aa, Artificial Sequence
  Synthetic Peptide
PPQRGPRPIREAG

SEQ ID NO: 909 - protein, 13 aa, Artificial Sequence
  Synthetic Peptide
KQQPAPRLTLRDL

SEQ ID NO: 910 - protein, 13 aa, Artificial Sequence
  Synthetic Peptide
TPTAPSRGRGGAV

SEQ ID NO: 911 - protein, 13 aa, Artificial Sequence
  Synthetic Peptide
TAPSRGRGGAVPP

SEQ ID NO: 912 - protein, 13 aa, Artificial Sequence
  Synthetic Peptide
PPPPPGRGVLTPR

SEQ ID NO: 913 - protein, 13 aa, Artificial Sequence
  Synthetic Peptide
RGVLTPRGTTVTR

SEQ ID NO: 914 - protein, 13 aa, Artificial Sequence
  Synthetic Peptide
TASTSSRPTFNVQ

SEQ ID NO: 915 - protein, 13 aa, Artificial Sequence
  Synthetic Peptide
LPRTALRTNLLSG

SEQ ID NO: 916 - protein, 13 aa, Artificial Sequence
  Synthetic Peptide
LKEPGARLEALHD

SEQ ID NO: 917 - protein, 13 aa, Artificial Sequence
  Synthetic Peptide
ENFNNLRYLMKFL

SEQ ID NO: 918 - protein, 13 aa, Artificial Sequence
  Synthetic Peptide
QNEARRRSTLFLS

SEQ ID NO: 919 - protein, 13 aa, Artificial Sequence
  Synthetic Peptide
RRELGYRAGLGSQ

SEQ ID NO: 920 - protein, 13 aa, Artificial Sequence
  Synthetic Peptide
PFLGLPRGTMRRQ

SEQ ID NO: 921 - protein, 13 aa, Artificial Sequence
  Synthetic Peptide
LPRGTMRRQKSID

SEQ ID NO: 922 - protein, 13 aa, Artificial Sequence
  Synthetic Peptide
VEDAQERAALAVG

SEQ ID NO: 923 - protein, 13 aa, Artificial Sequence
  Synthetic Peptide
SHPPLYRLPLLEN

SEQ ID NO: 924 - protein, 13 aa, Artificial Sequence
  Synthetic Peptide
LSQQTPRFNPIMV

SEQ ID NO: 925 - protein, 13 aa, Artificial Sequence
  Synthetic Peptide
SQSSSGRQTPQNA

SEQ ID NO: 926 - protein, 13 aa, Artificial Sequence
  Synthetic Peptide
QGRSLPRGALGPP

SEQ ID NO: 927 - protein, 13 aa, Artificial Sequence
  Synthetic Peptide
NVQRSMRGGYIGS

SEQ ID NO: 928 - protein, 13 aa, Artificial Sequence
  Synthetic Peptide
RFFHMPRFQHQAP

SEQ ID NO: 929 - protein, 13 aa, Artificial Sequence
  Synthetic Peptide
LLGDGPRAPFNQE

SEQ ID NO: 930 - protein, 13 aa, Artificial Sequence
  Synthetic Peptide
RDEQRNRGALLQD

SEQ ID NO: 931 - protein, 13 aa, Artificial Sequence
  Synthetic Peptide
GYSLLKRFPLHPL

SEQ ID NO: 932 - protein, 13 aa, Artificial Sequence
  Synthetic Peptide
VAPPGGRANITSL

SEQ ID NO: 933 - protein, 13 aa, Artificial Sequence
  Synthetic Peptide
CVDGFFRPKGVSP

SEQ ID NO: 934 - protein, 13 aa, Artificial Sequence
  Synthetic Peptide
PVPPPIRYGPPPQ

SEQ ID NO: 935 - protein, 13 aa, Artificial Sequence
  Synthetic Peptide
ARSSWPRSSVRSS

SEQ ID NO: 936 - protein, 13 aa, Artificial Sequence
  Synthetic Peptide
VSSVPSRAQSPSY

SEQ ID NO: 937 - protein, 13 aa, Artificial Sequence
  Synthetic Peptide
TGVSPSRGSLRTS

SEQ ID NO: 938 - protein, 13 aa, Artificial Sequence
  Synthetic Peptide
SANTQPRGPLSQA

SEQ ID NO: 939 - protein, 13 aa, Artificial Sequence
  Synthetic Peptide
LNRFPARGPHGRL

SEQ ID NO: 940 - protein, 13 aa, Artificial Sequence
  Synthetic Peptide
WGPFPVRPVNPGN

SEQ ID NO: 941 - protein, 13 aa, Artificial Sequence
  Synthetic Peptide
SQPGVQRFRTEAA

SEQ ID NO: 942 - protein, 13 aa, Artificial Sequence
  Synthetic Peptide
TPAPSPRFRGPSQ

SEQ ID NO: 943 - protein, 13 aa, Artificial Sequence
  Synthetic Peptide
GLFPRYRPQQGMR

SEQ ID NO: 944 - protein, 13 aa, Artificial Sequence
  Synthetic Peptide
RPQQGMRYSYQPP

SEQ ID NO: 945 - protein, 13 aa, Artificial Sequence
  Synthetic Peptide
ALKTKPRFDFANL

SEQ ID NO: 946 - protein, 13 aa, Artificial Sequence
  Synthetic Peptide
WDRNRRRGGGAAG

SEQ ID NO: 947 - protein, 13 aa, Artificial Sequence
  Synthetic Peptide
GAAGGGRGTGQLN

SEQ ID NO: 948 - protein, 13 aa, Artificial Sequence
  Synthetic Peptide
ANGKGRRGSLNAS

SEQ ID NO: 949 - protein, 13 aa, Artificial Sequence
  Synthetic Peptide
GGGNNFRGALGGG

SEQ ID NO: 950 - protein, 13 aa, Artificial Sequence
  Synthetic Peptide
PCGPRARPYGSSQ

SEQ ID NO: 951 - protein, 13 aa, Artificial Sequence
  Synthetic Peptide
GSSQSPRHGGNFS

SEQ ID NO: 952 - protein, 13 aa, Artificial Sequence
  Synthetic Peptide
ALASQYRAMMPPY

SEQ ID NO: 953 - protein, 13 aa, Artificial Sequence
  Synthetic Peptide
KGEPTRRGRGGTF

SEQ ID NO: 954 - protein, 13 aa, Artificial Sequence
  Synthetic Peptide
EPTRRGRGGTFRR

SEQ ID NO: 955 - protein, 13 aa, Artificial Sequence
  Synthetic Peptide
KLRQPARPPLTPH

SEQ ID NO: 956 - protein, 13 aa, Artificial Sequence
  Synthetic Peptide
PHTFEPRPARGPL

SEQ ID NO: 957 - protein, 13 aa, Artificial Sequence
  Synthetic Peptide
FEPRPARGPLLRS

SEQ ID NO: 958 - protein, 13 aa, Artificial Sequence
  Synthetic Peptide
ARGPLLRSGSDAG

SEQ ID NO: 959 - protein, 13 aa, Artificial Sequence
  Synthetic Peptide
NPVNNVRPGFPVS

SEQ ID NO: 960 - protein, 13 aa, Artificial Sequence
  Synthetic Peptide
QSGSPVRYQQETN

SEQ ID NO: 961 - protein, 13 aa, Artificial Sequence
  Synthetic Peptide
VSQLPGRPKSPLS

SEQ ID NO: 962 - protein, 13 aa, Artificial Sequence
  Synthetic Peptide
GVGQSVRLGLGGN

SEQ ID NO: 963 - protein, 13 aa, Artificial Sequence
  Synthetic Peptide
TSQVSPRARFPIS

SEQ ID NO: 964 - protein, 13 aa, Artificial Sequence
  Synthetic Peptide
QVSPRARFPISIT

SEQ ID NO: 965 - protein, 13 aa, Artificial Sequence
  Synthetic Peptide
FGHQVNRQVFRQG

SEQ ID NO: 966 - protein, 13 aa, Artificial Sequence
  Synthetic Peptide
PQQGAVRPQTLNF

SEQ ID NO: 967 - protein, 13 aa, Artificial Sequence
  Synthetic Peptide
TLNFSSRNQTVPS

SEQ ID NO: 968 - protein, 13 aa, Artificial Sequence
  Synthetic Peptide
GVKKPHRYRPGTV

SEQ ID NO: 969 - protein, 13 aa, Artificial Sequence
  Synthetic Peptide
PQDSSPRLSTFPQ

SEQ ID NO: 970 - protein, 13 aa, Artificial Sequence
  Synthetic Peptide
FSHPTIRYPPHLN

SEQ ID NO: 971 - protein, 13 aa, Artificial Sequence
  Synthetic Peptide
PGPPALRPTRPLQ

SEQ ID NO: 972 - protein, 13 aa, Artificial Sequence
  Synthetic Peptide
PALRPTRPLQTVP

SEQ ID NO: 973 - protein, 13 aa, Artificial Sequence
  Synthetic Peptide
SHSPSSRFVPPQT

SEQ ID NO: 974 - protein, 13 aa, Artificial Sequence
  Synthetic Peptide
VTPCVPRFVRSSN

SEQ ID NO: 975 - protein, 13 aa, Artificial Sequence
  Synthetic Peptide
CVPRFVRSSNVPE

SEQ ID NO: 976 - protein, 13 aa, Artificial Sequence
  Synthetic Peptide
GNILGPRVPLTAP

SEQ ID NO: 977 - protein, 13 aa, Artificial Sequence
  Synthetic Peptide
MSYAAERSMMSSY

SEQ ID NO: 978 - protein, 13 aa, Artificial Sequence
  Synthetic Peptide
SMMSYERSMMSPM

SEQ ID NO: 979 - protein, 13 aa, Artificial Sequence
  Synthetic Peptide
YPFMSPRYPGGPR

SEQ ID NO: 980 - protein, 13 aa, Artificial Sequence
  Synthetic Peptide
RYPGGPRPPLRIP

SEQ ID NO: 981 - protein, 13 aa, Artificial Sequence
  Synthetic Peptide
GPRPPLRIPNQAL

SEQ ID NO: 982 - protein, 13 aa, Artificial Sequence
  Synthetic Peptide
LSPGGARTYLQMK

SEQ ID NO: 983 - protein, 13 aa, Artificial Sequence
  Synthetic Peptide
ASRIGLRMQLMRE

SEQ ID NO: 984 - protein, 13 aa, Artificial Sequence
  Synthetic Peptide
PPPQKVRINLQQQ

SEQ ID NO: 985 - protein, 13 aa, Artificial Sequence
  Synthetic Peptide
SPQHFHRPELLSP

SEQ ID NO: 986 - protein, 13 aa, Artificial Sequence
  Synthetic Peptide
RPNPPFRHHFLPH

SEQ ID NO: 987 - protein, 13 aa, Artificial Sequence
  Synthetic Peptide
HPLPLRRYSSVSN

SEQ ID NO: 988 - protein, 13 aa, Artificial Sequence
  Synthetic Peptide
VPMIAPRVPLGPA

SEQ ID NO: 989 - protein, 13 aa, Artificial Sequence
  Synthetic Peptide
GPAGLYRYPAPRF

SEQ ID NO: 990 - protein, 13 aa, Artificial Sequence
  Synthetic Peptide
YRYPAPRFPIASS

SEQ ID NO: 991 - protein, 13 aa, Artificial Sequence
  Synthetic Peptide
QLGTMPRFSLSRM

SEQ ID NO: 992 - protein, 13 aa, Artificial Sequence
  Synthetic Peptide
LQVTAGRHGDDLR

SEQ ID NO: 993 - protein, 13 aa, Artificial Sequence
  Synthetic Peptide
YIEKYTRGVLQVE

SEQ ID NO: 994 - protein, 13 aa, Artificial Sequence
  Synthetic Peptide
LKQEQLRLQGLQG

SEQ ID NO: 995 - protein, 13 aa, Artificial Sequence
  Synthetic Peptide
LQGAGGRGGGLRR

SEQ ID NO: 996 - protein, 13 aa, Artificial Sequence
  Synthetic Peptide
VRVSSTRGSLGGG

SEQ ID NO: 997 - protein, 13 aa, Artificial Sequence
  Synthetic Peptide
GGGGGFRGFSSGS

SEQ ID NO: 998 - protein, 13 aa, Artificial Sequence
  Synthetic Peptide
QVTPLARGTFQRA

SEQ ID NO: 999 - protein, 13 aa, Artificial Sequence
  Synthetic Peptide
RACCIARFWNQLD

SEQ ID NO: 1000 - protein, 13 aa, Artificial Sequence
  Synthetic Peptide
RYVETPRVHISSV

SEQ ID NO: 1001 - protein, 13 aa, Artificial Sequence
  Synthetic Peptide
TRSSFSRVSGSPS

SEQ ID NO: 1002 - protein, 13 aa, Artificial Sequence
  Synthetic Peptide
RSQSWSRGSPSTV

SEQ ID NO: 1003 - protein, 13 aa, Artificial Sequence
  Synthetic Peptide
PPADPPRYTFAPS

SEQ ID NO: 1004 - protein, 13 aa, Artificial Sequence
  Synthetic Peptide
PSGSPSRSRLSYA

SEQ ID NO: 1005 - protein, 13 aa, Artificial Sequence
  Synthetic Peptide
SRGSPVRQSFRKD

SEQ ID NO: 1006 - protein, 13 aa, Artificial Sequence
  Synthetic Peptide
PVRQSFRKDSGSS

SEQ ID NO: 1007 - protein, 13 aa, Artificial Sequence
  Synthetic Peptide
NSASDLRGQLQQL

SEQ ID NO: 1008 - protein, 13 aa, Artificial Sequence
  Synthetic Peptide
LDEPIWRAELAST

SEQ ID NO: 1009 - protein, 13 aa, Artificial Sequence
  Synthetic Peptide
CGFQVARPRFSAT

SEQ ID NO: 1010 - protein, 13 aa, Artificial Sequence
  Synthetic Peptide
FQVARPRFSATRT

SEQ ID NO: 1011 - protein, 13 aa, Artificial Sequence
  Synthetic Peptide
PRFSATRTGLQAH

SEQ ID NO: 1012 - protein, 13 aa, Artificial Sequence
  Synthetic Peptide
  misc_feature (11)..(13): Xaa can be any naturally occurring amino acid
TGYGMPRQILXXX

SEQ ID NO: 1013 - protein, 13 aa, Artificial Sequence
  Synthetic Peptide
REEYPDRIMNTFS

SEQ ID NO: 1014 - protein, 13 aa, Artificial Sequence
  Synthetic Peptide
TVAAVFRGRMSMK

SEQ ID NO: 1015 - protein, 13 aa, Artificial Sequence
  Synthetic Peptide
AAVFRGRMSMKEV

SEQ ID NO: 1016 - protein, 13 aa, Artificial Sequence
  Synthetic Peptide
QVLGYKRRLDEVT

SEQ ID NO: 1017 - protein, 13 aa, Artificial Sequence
  Synthetic Peptide
LSTSSLRASMTST

SEQ ID NO: 1018 - protein, 13 aa, Artificial Sequence
  Synthetic Peptide
KPDLKGRSALLAD

SEQ ID NO: 1019 - protein, 13 aa, Artificial Sequence
  Synthetic Peptide
SRAPSPRLPIKAI

SEQ ID NO: 1020 - protein, 13 aa, Artificial Sequence
  Synthetic Peptide
GGGSLGRVLIRQQ

SEQ ID NO: 1021 - protein, 13 aa, Artificial Sequence
  Synthetic Peptide
LGRVLIRQQTQRS

SEQ ID NO: 1022 - protein, 13 aa, Artificial Sequence
  Synthetic Peptide
DAFKEDRKIACAA

SEQ ID NO: 1023 - protein, 13 aa, Artificial Sequence
  Synthetic Peptide
TPSADPRLPLVPC

SEQ ID NO: 1024 - protein, 13 aa, Artificial Sequence
  Synthetic Peptide
ELLRSLRLCPPHP

SEQ ID NO: 1025 - protein, 13 aa, Artificial Sequence
  Synthetic Peptide
PPHPTARLLLATD

SEQ ID NO: 1026 - protein, 13 aa, Artificial Sequence
  Synthetic Peptide
GRSKSSRFSGGFG

SEQ ID NO: 1027 - protein, 13 aa, Artificial Sequence
  Synthetic Peptide
QSRQGSRSGSRQD

SEQ ID NO: 1028 - protein, 13 aa, Artificial Sequence
  Synthetic Peptide
LQTGAARFSSYLL

SEQ ID NO: 1029 - protein, 13 aa, Artificial Sequence
  Synthetic Peptide
LLNAVARVERAMP

SEQ ID NO: 1030 - protein, 13 aa, Artificial Sequence
  Synthetic Peptide
IPPLGPRYAVFPK

SEQ ID NO: 1031 - protein, 13 aa, Artificial Sequence
  Synthetic Peptide
APDGRSRLPFAAS

SEQ ID NO: 1032 - protein, 13 aa, Artificial Sequence
  Synthetic Peptide
NPSLEYRQHLLLR

SEQ ID NO: 1033 - protein, 13 aa, Artificial Sequence
  Synthetic Peptide
ARMGEPRAPLVPD

SEQ ID NO: 1034 - protein, 13 aa, Artificial Sequence
  Synthetic Peptide
VSGQVLRYDSAVD

SEQ ID NO: 1035 - protein, 13 aa, Artificial Sequence
  Synthetic Peptide
HLPLSVRPQLKAV

SEQ ID NO: 1036 - protein, 13 aa, Artificial Sequence
  Synthetic Peptide
VYSYHSRYAQPGL

SEQ ID NO: 1037 - protein, 13 aa, Artificial Sequence
  Synthetic Peptide
GVLPNRRLGAVRG

SEQ ID NO: 1038 - protein, 13 aa, Artificial Sequence
  Synthetic Peptide
RRLGAVRGGLMSS

SEQ ID NO: 1039 - protein, 13 aa, Artificial Sequence
  Synthetic Peptide
IGFSIIRKCIHAV

SEQ ID NO: 1040 - protein, 13 aa, Artificial Sequence
  Synthetic Peptide
HQVYGARSEPPAS

SEQ ID NO: 1041 - protein, 13 aa, Artificial Sequence
  Synthetic Peptide
PASMGPRYNTYVA

SEQ ID NO: 1042 - protein, 13 aa, Artificial Sequence
  Synthetic Peptide
SPAPVWRNSLGAP

SEQ ID NO: 1043 - protein, 13 aa, Artificial Sequence
  Synthetic Peptide
GRGGEVRGSLYRN

SEQ ID NO: 1044 - protein, 13 aa, Artificial Sequence
  Synthetic Peptide
PQLGTGRGTLRLR

SEQ ID NO: 1045 - protein, 13 aa, Artificial Sequence
  Synthetic Peptide
EEISNMRKELEKY

SEQ ID NO: 1046 - protein, 13 aa, Artificial Sequence
  Synthetic Peptide
SSGKRVRASLDSA

SEQ ID NO: 1047 - protein, 13 aa, Artificial Sequence
  Synthetic Peptide
EHFFTSRASLLDQ

SEQ ID NO: 1048 - protein, 13 aa, Artificial Sequence
  Synthetic Peptide
DLFYVSRPPLARS

SEQ ID NO: 1049 - protein, 13 aa, Artificial Sequence
  Synthetic Peptide
KSRTNARGAPLNI

SEQ ID NO: 1050 - protein, 13 aa, Artificial Sequence
  Synthetic Peptide
STQISPRPQINPS

SEQ ID NO: 1051 - protein, 13 aa, Artificial Sequence
  Synthetic Peptide
DAKTRRRIFDAVG

SEQ ID NO: 1052 - protein, 13 aa, Artificial Sequence
  Synthetic Peptide
ILYPSVRAGMSGS

SEQ ID NO: 1053 - protein, 13 aa, Artificial Sequence
  Synthetic Peptide
SPSKKGRGALLAV

SEQ ID NO: 1054 - protein, 13 aa, Artificial Sequence
  Synthetic Peptide
PVPDTARYYKKHG

SEQ ID NO: 1055 - protein, 13 aa, Artificial Sequence
  Synthetic Peptide
GVGERTREGNDLY

SEQ ID NO: 1056 - protein, 13 aa, Artificial Sequence
  Synthetic Peptide
QLKILIRPLYSNP

SEQ ID NO: 1057 - protein, 13 aa, Artificial Sequence
  Synthetic Peptide
LFLQKCREVAENC

SEQ ID NO: 1058 - protein, 13 aa, Artificial Sequence
  Synthetic Peptide
PASSEPRLTLAPV

SEQ ID NO: 1059 - protein, 13 aa, Artificial Sequence
  Synthetic Peptide
LAPVGPRAAVSPP

SEQ ID NO: 1060 - protein, 13 aa, Artificial Sequence
  Synthetic Peptide
VSPPSERPRLVLS

SEQ ID NO: 1061 - protein, 13 aa, Artificial Sequence
  Synthetic Peptide
PPSERPRLVLSSP

SEQ ID NO: 1062 - protein, 13 aa, Artificial Sequence
  Synthetic Peptide
LVLSSPRPVLAPL

SEQ ID NO: 1063 - protein, 13 aa, Artificial Sequence
  Synthetic Peptide
AASSGARALKTLR

SEQ ID NO: 1064 - protein, 13 aa, Artificial Sequence
  Synthetic Peptide
LGRLPSRPPLPGS

SEQ ID NO: 1065 - protein, 13 aa, Artificial Sequence
  Synthetic Peptide
PLTVAIRPFLADK

SEQ ID NO: 1066 - protein, 13 aa, Artificial Sequence
  Synthetic Peptide
LRSGFPRVLIDPS

SEQ ID NO: 1067 - protein, 13 aa, Artificial Sequence
  Synthetic Peptide
SLNNSTRGSLLSW

SEQ ID NO: 1068 - protein, 13 aa, Artificial Sequence
  Synthetic Peptide
LITFQLRHILKAR

SEQ ID NO: 1069 - protein, 13 aa, Artificial Sequence
  Synthetic Peptide
INLAQLRLQHMQQ

SEQ ID NO: 1070 - protein, 13 aa, Artificial Sequence
  Synthetic Peptide
SVQTMQRGNMNCG

SEQ ID NO: 1071 - protein, 13 aa, Artificial Sequence
  Synthetic Peptide
FQAHQMRLAQNAA

SEQ ID NO: 1072 - protein, 13 aa, Artificial Sequence
  Synthetic Peptide
LAQNAARIPGIPR

SEQ ID NO: 1073 - protein, 13 aa, Artificial Sequence
  Synthetic Peptide
RIPGIPRHSAPQY

SEQ ID NO: 1074 - protein, 13 aa, Artificial Sequence
  Synthetic Peptide
PVKSTARFTLNPN

SEQ ID NO: 1075 - protein, 13 aa, Artificial Sequence
  Synthetic Peptide
KFSLQERPAGSCL

SEQ ID NO: 1076 - protein, 13 aa, Artificial Sequence
  Synthetic Peptide
RSGMVPRGPPATA

SEQ ID NO: 1077 - protein, 13 aa, Artificial Sequence
  Synthetic Peptide
GPPATARFGVPAE

SEQ ID NO: 1078 - protein, 13 aa, Artificial Sequence
  Synthetic Peptide
GATRLTRGGLGEG

SEQ ID NO: 1079 - protein, 13 aa, Artificial Sequence
  Synthetic Peptide
EAVSRIRSVSPRS

SEQ ID NO: 1080 - protein, 13 aa, Artificial Sequence
  Synthetic Peptide
IRSVSPRSLSRSP

SEQ ID NO: 1081 - protein, 13 aa, Artificial Sequence
  Synthetic Peptide
SPRSLSRSPIRMS

SEQ ID NO: 1082 - protein, 13 aa, Artificial Sequence
  Synthetic Peptide
SARVTLREPPSFI

SEQ ID NO: 1083 - protein, 13 aa, Artificial Sequence
  Synthetic Peptide
VVPYLPRLPLLPS

SEQ ID NO: 1084 - protein, 13 aa, Artificial Sequence
  Synthetic Peptide
SNVSNARYMAPKQ

SEQ ID NO: 1085 - protein, 13 aa, Artificial Sequence
  Synthetic Peptide
DFSRSSRGSLNGG

SEQ ID NO: 1086 - protein, 13 aa, Artificial Sequence
  Synthetic Peptide
SGRMLLRMSQALG

SEQ ID NO: 1087 - protein, 13 aa, Artificial Sequence
  Synthetic Peptide
MSQALGRIVLAGR

SEQ ID NO: 1088 - protein, 13 aa, Artificial Sequence
  Synthetic Peptide
RIVLAGREMTRLA

SEQ ID NO: 1089 - protein, 13 aa, Artificial Sequence
  Synthetic Peptide
FLYEYSRRHPDYS

SEQ ID NO: 1090 - protein, 13 aa, Artificial Sequence
  Synthetic Peptide
LYEYSRRHPDYSV

SEQ ID NO: 1091 - protein, 13 aa, Artificial Sequence
  Synthetic Peptide
GQILWFRGLNRIQ

SEQ ID NO: 1092 - protein, 13 aa, Artificial Sequence
  Synthetic Peptide
QPYYNSRGVSRGG

SEQ ID NO: 1093 - protein, 13 aa, Artificial Sequence
  Synthetic Peptide
NSRGVSRGGSRGA

SEQ ID NO: 1094 - protein, 13 aa, Artificial Sequence
  Synthetic Peptide
VSRGGSRGARGLM

SEQ ID NO: 1095 - protein, 13 aa, Artificial Sequence
  Synthetic Peptide
GGSRGARGLMNGY

SEQ ID NO: 1096 - protein, 13 aa, Artificial Sequence
  Synthetic Peptide
PRSQFMRRGPSFP

SEQ ID NO: 1097 - protein, 13 aa, Artificial Sequence
  Synthetic Peptide
YQYSLPRPAYRFS

SEQ ID NO: 1098 - protein, 13 aa, Artificial Sequence
  Synthetic Peptide
LPRPAYRFSQLPE

SEQ ID NO: 1099 - protein, 13 aa, Artificial Sequence
  Synthetic Peptide
GGEALGRLLVVYP

SEQ ID NO: 1100 - protein, 13 aa, Artificial Sequence
  Synthetic Peptide
VDPENFRLLGNAI

SEQ ID NO: 1101 - protein, 13 aa, Artificial Sequence
  Synthetic Peptide
SELELSRGELSRG

SEQ ID NO: 1102 - protein, 13 aa, Artificial Sequence
  Synthetic Peptide
PFRHICRLCYRVL

SEQ ID NO: 1103 - protein, 13 aa, Artificial Sequence
  Synthetic Peptide
KKGGLFRRGSLLG

SEQ ID NO: 1104 - protein, 13 aa, Artificial Sequence
  Synthetic Peptide
KGGLFRRGSLLGS

SEQ ID NO: 1105 - protein, 13 aa, Artificial Sequence
  Synthetic Peptide
ATAEAARPQGLFT

SEQ ID NO: 1106 - protein, 13 aa, Artificial Sequence
  Synthetic Peptide
GMIYSTRYGSPKR

SEQ ID NO: 1107 - protein, 13 aa, Artificial Sequence
  Synthetic Peptide
  misc_feature (9)..(13): Xaa can be any naturally occurring amino acid
QSSAYQRIXXXXX

SEQ ID NO: 1108 - protein, 13 aa, Artificial Sequence
  Synthetic Peptide
LGADGSRKDKAGH

SEQ ID NO: 1109 - protein, 13 aa, Artificial Sequence
  Synthetic Peptide
QTKSPFRFGQPSL

SEQ ID NO: 1110 - protein, 13 aa, Artificial Sequence
  Synthetic Peptide
RTPSSFRQPFVTP

SEQ ID NO: 1111 - protein, 13 aa, Artificial Sequence
  Synthetic Peptide
QSLLSIRGSLFSP

SEQ ID NO: 1112 - protein, 13 aa, Artificial Sequence
  Synthetic Peptide
SPRRNSRASLFSF

SEQ ID NO: 1113 - protein, 13 aa, Artificial Sequence
  Synthetic Peptide
MRPRSSRGSIFTF

SEQ ID NO: 1114 - protein, 13 aa, Artificial Sequence
  Synthetic Peptide
YITLLERRGNGLL

SEQ ID NO: 1115 - protein, 13 aa, Artificial Sequence
  Synthetic Peptide
KSRAFYRIQATRM

SEQ ID NO: 1116 - protein, 13 aa, Artificial Sequence
  Synthetic Peptide
YRIQATRMMTGAG

SEQ ID NO: 1117 - protein, 13 aa, Artificial Sequence
  Synthetic Peptide
EFPAFPRAQVFGR

SEQ ID NO: 1118 - protein, 13 aa, Artificial Sequence
  Synthetic Peptide
RAQVFGRFEASVI

SEQ ID NO: 1119 - protein, 13 aa, Artificial Sequence
  Synthetic Peptide
LSTCVVRFAKTGA

SEQ ID NO: 1120 - protein, 13 aa, Artificial Sequence
  Synthetic Peptide
SSFRTCRGFLSAG

SEQ ID NO: 1121 - protein, 13 aa, Artificial Sequence
  Synthetic Peptide
PEPAPPRPSLSQD

SEQ ID NO: 1122 - protein, 13 aa, Artificial Sequence
  Synthetic Peptide
YRAAGGRSRSNPG

SEQ ID NO: 1123 - protein, 13 aa, Artificial Sequence
  Synthetic Peptide
AAGGRSRSNPGSW

SEQ ID NO: 1124 - protein, 13 aa, Artificial Sequence
  Synthetic Peptide
IEELKQRNGALDQ

SEQ ID NO: 1125 - protein, 13 aa, Artificial Sequence
  Synthetic Peptide
QVAGVPRFRFGPP

SEQ ID NO: 1126 - protein, 13 aa, Artificial Sequence
  Synthetic Peptide
AGVPRFRFGPPED

SEQ ID NO: 1127 - protein, 13 aa, Artificial Sequence
  Synthetic Peptide
RGRQFNRQRGISH

SEQ ID NO: 1128 - protein, 13 aa, Artificial Sequence
  Synthetic Peptide
RQFNRQRGISHAM

SEQ ID NO: 1129 - protein, 13 aa, Artificial Sequence
  Synthetic Peptide
SHAMGGRGGINRG

SEQ ID NO: 1130 - protein, 13 aa, Artificial Sequence
  Synthetic Peptide
  misc_feature (12)..(13): Xaa can be any naturally occurring amino acid
GRGGINRGNINXX

SEQ ID NO: 1131 - protein, 13 aa, Artificial Sequence
  Synthetic Peptide
PRGSVLRYGSRDD

SEQ ID NO: 1132 - protein, 13 aa, Artificial Sequence
  Synthetic Peptide
PRDRASRGRGGLG

SEQ ID NO: 1133 - protein, 13 aa, Artificial Sequence
  Synthetic Peptide
DRASRGRGGLGPS

SEQ ID NO: 1134 - protein, 13 aa, Artificial Sequence
  Synthetic Peptide
SGSGGSRGKFVSG

SEQ ID NO: 1135 - protein, 13 aa, Artificial Sequence
  Synthetic Peptide
VRGLGGRGYLAYT

SEQ ID NO: 1136 - protein, 13 aa, Artificial Sequence
  Synthetic Peptide
AYTGLGRGYHVKG

SEQ ID NO: 1137 - protein, 13 aa, Artificial Sequence
  Synthetic Peptide
GPESYPRSFQLQQ

SEQ ID NO: 1138 - protein, 13 aa, Artificial Sequence
  Synthetic Peptide
IEFLKGRLPEAPL

SEQ ID NO: 1139 - protein, 13 aa, Artificial Sequence
  Synthetic Peptide
LPGHWPRFPGPPA

SEQ ID NO: 1140 - protein, 13 aa, Artificial Sequence
  Synthetic Peptide
GPPAQDRQLEIWE

SEQ ID NO: 1141 - protein, 13 aa, Artificial Sequence
  Synthetic Peptide
MSPKAQRHPRNHR

SEQ ID NO: 1142 - protein, 13 aa, Artificial Sequence
  Synthetic Peptide
KAQRHPRNHRVSA

SEQ ID NO: 1143 - protein, 13 aa, Artificial Sequence
  Synthetic Peptide
APPKFPRAAPLTS

SEQ ID NO: 1144 - protein, 13 aa, Artificial Sequence
  Synthetic Peptide
HQAQRFRFSPMGV

SEQ ID NO: 1145 - protein, 13 aa, Artificial Sequence
  Synthetic Peptide
LAQQAQRFRLDNL

SEQ ID NO: 1146 - protein, 13 aa, Artificial Sequence
  Synthetic Peptide
LHHQTQRFRLDNL

SEQ ID NO: 1147 - protein, 13 aa, Artificial Sequence
  Synthetic Peptide
GGSYGGRGRGRRT

SEQ ID NO: 1148 - protein, 13 aa, Artificial Sequence
  Synthetic Peptide
SYGGRGRGRRTGG

SEQ ID NO: 1149 - protein, 13 aa, Artificial Sequence
  Synthetic Peptide
SSSQRGRSGSGNF

SEQ ID NO: 1150 - protein, 13 aa, Artificial Sequence
  Synthetic Peptide
GGGGGSRGSYGGG

SEQ ID NO: 1151 - protein, 13 aa, Artificial Sequence
  Synthetic Peptide
NYGKSQRRGGHQN

SEQ ID NO: 1152 - protein, 13 aa, Artificial Sequence
  Synthetic Peptide
GYGKVSRRGGHQN

SEQ ID NO: 1153 - protein, 13 aa, Artificial Sequence
  Synthetic Peptide
PVGGHRRGPSRYG

SEQ ID NO: 1154 - protein, 13 aa, Artificial Sequence
  Synthetic Peptide
HRRGPSRYGPQYG

SEQ ID NO: 1155 - protein, 13 aa, Artificial Sequence
  Synthetic Peptide
GPPGGNRGGFQNR

SEQ ID NO: 1156 - protein, 13 aa, Artificial Sequence
  Synthetic Peptide
KGGRRRRPDLFRR

SEQ ID NO: 1157 - protein, 13 aa, Artificial Sequence
  Synthetic Peptide
APTPRARTAGIQR

SEQ ID NO: 1158 - protein, 13 aa, Artificial Sequence
  Synthetic Peptide
GGGGRGRGGGGGG

SEQ ID NO: 1159 - protein, 13 aa, Artificial Sequence
  Synthetic Peptide
GNRRSGRGGSGVQ

SEQ ID NO: 1160 - protein, 13 aa, Artificial Sequence
  Synthetic Peptide
LRQSGPRPALRHL

SEQ ID NO: 1161 - protein, 13 aa, Artificial Sequence
  Synthetic Peptide
GPRPALRHLAPTG

SEQ ID NO: 1162 - protein, 13 aa, Artificial Sequence
  Synthetic Peptide
ESLFRGRQIKVIP

SEQ ID NO: 1163 - protein, 13 aa, Artificial Sequence
  Synthetic Peptide
GGGGPMRFEGPQG

SEQ ID NO: 1164 - protein, 13 aa, Artificial Sequence
  Synthetic Peptide
GGGCPLRFEGPPG

SEQ ID NO: 1165 - protein, 13 aa, Artificial Sequence
  Synthetic Peptide
PVGTPLRFEGPIG

SEQ ID NO: 1166 - protein, 13 aa, Artificial Sequence
  Synthetic Peptide
EGSPSLRFEGSTG

SEQ ID NO: 1167 - protein, 13 aa, Artificial Sequence
  Synthetic Peptide
GSTGGLRFEGPGG

SEQ ID NO: 1168 - protein, 13 aa, Artificial Sequence
  Synthetic Peptide
QPVGGLRFEGHRG

SEQ ID NO: 1169 - protein, 13 aa, Artificial Sequence
  Synthetic Peptide
LRFEGHRGQPVGG

SEQ ID NO: 1170 - protein, 13 aa, Artificial Sequence
  Synthetic Peptide
QPVGGLRFEGPHG

SEQ ID NO: 1171 - protein, 13 aa, Artificial Sequence
  Synthetic Peptide
QPVGSLRFDNPRG

SEQ ID NO: 1172 - protein, 13 aa, Artificial Sequence
  Synthetic Peptide
QPSLLPRFDGLHG

SEQ ID NO: 1173 - protein, 13 aa, Artificial Sequence
  Synthetic Peptide
HGQPGPRFERTGQ

SEQ ID NO: 1174 - protein, 13 aa, Artificial Sequence
  Synthetic Peptide
PGPRFERTGQPGP

SEQ ID NO: 1175 - protein, 13 aa, Artificial Sequence
  Synthetic Peptide
GQPGPQRFDGPPG

SEQ ID NO: 1176 - protein, 13 aa, Artificial Sequence
  Synthetic Peptide
GQQVQPRFDGVPQ

SEQ ID NO: 1177 - protein, 13 aa, Artificial Sequence
  Synthetic Peptide
FDGVPQRFDGPQH

SEQ ID NO: 1178 - protein, 13 aa, Artificial Sequence
  Synthetic Peptide
QHQQASRFDIPLG

SEQ ID NO: 1179 - protein, 13 aa, Artificial Sequence
  Synthetic Peptide
FSSSRLRYGMSDV

SEQ ID NO: 1180 - protein, 13 aa, Artificial Sequence
  Synthetic Peptide
GGYAAYRYAQPTP

SEQ ID NO: 1181 - protein, 13 aa, Artificial Sequence
  Synthetic Peptide
FRGAHLRGRGRTV

SEQ ID NO: 1182 - protein, 13 aa, Artificial Sequence
  Synthetic Peptide
TTAAAFRGAHLRG

SEQ ID NO: 1183 - protein, 13 aa, Artificial Sequence
  Synthetic Peptide
TVYGAVRAVPPTA

SEQ ID NO: 1184 - protein, 13 aa, Artificial Sequence
  Synthetic Peptide
GGYAAYRYAQPAT

SEQ ID NO: 1185 - protein, 13 aa, Artificial Sequence
  Synthetic Peptide
AVASLYRGGYSRF

SEQ ID NO: 1186 - protein, 13 aa, Artificial Sequence
  Synthetic Peptide
  misc_feature (12)..(13): Xaa can be any naturally occurring amino acid
YRGGYSRFAPYXX

SEQ ID NO: 1187 - protein, 13 aa, Artificial Sequence
  Synthetic Peptide
GTAVAYRGAHLRG

SEQ ID NO: 1188 - protein, 13 aa, Artificial Sequence
  Synthetic Peptide
GGYAAYRYAQPAA

SEQ ID NO: 1189 - protein, 13 aa, Artificial Sequence
  Synthetic Peptide
SRRGGRRGGSLMC

SEQ ID NO: 1190 - protein, 13 aa, Artificial Sequence
  Synthetic Peptide
VAGPMGRGRLMPN

SEQ ID NO: 1191 - protein, 13 aa, Artificial Sequence
  Synthetic Peptide
NRTPGPRGSYLGG

SEQ ID NO: 1192 - protein, 13 aa, Artificial Sequence
  Synthetic Peptide
GGYSAGRGIYSRY

SEQ ID NO: 1193 - protein, 13 aa, Artificial Sequence
  Synthetic Peptide
TRGPPSRGGYMDD

SEQ ID NO: 1194 - protein, 13 aa, Artificial Sequence
  Synthetic Peptide
RGKGAYRGNFACN

SEQ ID NO: 1195 - protein, 13 aa, Artificial Sequence
  Synthetic Peptide
MRENLVRPSLDHL

SEQ ID NO: 1196 - protein, 13 aa, Artificial Sequence
  Synthetic Peptide
  misc_feature (11)..(13): Xaa can be any naturally occurring amino acid
MRVRTFRAHWXXX

SEQ ID NO: 1197 - protein, 13 aa, Artificial Sequence
  Synthetic Peptide
MGTAVPRPPQDMG

SEQ ID NO: 1198 - protein, 13 aa, Artificial Sequence
  Synthetic Peptide
MGQLGVRTPLGPR

SEQ ID NO: 1199 - protein, 13 aa, Artificial Sequence
  Synthetic Peptide
APVPRPRGPPPPP

SEQ ID NO: 1200 - protein, 13 aa, Artificial Sequence
  Synthetic Peptide
NSVPVPRHWCFKR

SEQ ID NO: 1201 - protein, 13 aa, Artificial Sequence
  Synthetic Peptide
VPVKRPRHELLLG

SEQ ID NO: 1202 - protein, 13 aa, Artificial Sequence
  Synthetic Peptide
TRTTRRRDRSGSS

SEQ ID NO: 1203 - protein, 13 aa, Artificial Sequence
  Synthetic Peptide
SQSTSRRRQRSRS

SEQ ID NO: 1204 - protein, 13 aa, Artificial Sequence
  Synthetic Peptide
ANLTSPRVPLSAY

SEQ ID NO: 1205 - protein, 13 aa, Artificial Sequence
  Synthetic Peptide
PLSAYDRVSGRTS

SEQ ID NO: 1206 - protein, 13 aa, Artificial Sequence
  Synthetic Peptide
RGPPPRRYGGGGY

SEQ ID NO: 1207 - protein, 13 aa, Artificial Sequence
  Synthetic Peptide
TYSYGMRGGAYPP

SEQ ID NO: 1208 - protein, 13 aa, Artificial Sequence
  Synthetic Peptide
GGAYPPRYFYPFP

SEQ ID NO: 1209 - protein, 13 aa, Artificial Sequence
  Synthetic Peptide
RGMYNQRYHCPMP

SEQ ID NO: 1210 - protein, 13 aa, Artificial Sequence
  Synthetic Peptide
AVRGRGRGTLTRG

SEQ ID NO: 1211 - protein, 13 aa, Artificial Sequence
  Synthetic Peptide
GRGTLTRGAFVGA

SEQ ID NO: 1212 - protein, 13 aa, Artificial Sequence
  Synthetic Peptide
MLAYRFRPNPLNN

SEQ ID NO: 1213 - protein, 13 aa, Artificial Sequence
  Synthetic Peptide
PLFQQHRFERSVG

SEQ ID NO: 1214 - protein, 13 aa, Artificial Sequence
  Synthetic Peptide
QQHRFERSVGAEP

SEQ ID NO: 1215 - protein, 13 aa, Artificial Sequence
  Synthetic Peptide
  misc_feature (12)..(13): Xaa can be any naturally occurring amino acid
LPPPSGRYSWNXX

SEQ ID NO: 1216 - protein, 13 aa, Artificial Sequence
  Synthetic Peptide
RSRSKSRSSHSRS

SEQ ID NO: 1217 - protein, 13 aa, Artificial Sequence
  Synthetic Peptide
SRSSHSRSSSRSS

SEQ ID NO: 1218 - protein, 13 aa, Artificial Sequence
  Synthetic Peptide
PKPVHVRPPMPPR

SEQ ID NO: 1219 - protein, 13 aa, Artificial Sequence
  Synthetic Peptide
RPPMPPRYPAPYG

SEQ ID NO: 1220 - protein, 13 aa, Artificial Sequence
  Synthetic Peptide
PAPYGERISPNQL

SEQ ID NO: 1221 - protein, 13 aa, Artificial Sequence
  Synthetic Peptide
LASGVDRYISKYE

SEQ ID NO: 1222 - protein, 13 aa, Artificial Sequence
  Synthetic Peptide
GLPIIQRGLPRGG

SEQ ID NO: 1223 - protein, 13 aa, Artificial Sequence
  Synthetic Peptide
IQRGLPRGGLRGG

SEQ ID NO: 1224 - protein, 13 aa, Artificial Sequence
  Synthetic Peptide
LPRGGLRGGRATR

SEQ ID NO: 1225 - protein, 13 aa, Artificial Sequence
  Synthetic Peptide
GGLRGGRATRTLL

SEQ ID NO: 1226 - protein, 13 aa, Artificial Sequence
  Synthetic Peptide
RGAIGGRGLPIIQ

SEQ ID NO: 1227 - protein, 13 aa, Artificial Sequence
  Synthetic Peptide
ATRTLLRGGMSLR

SEQ ID NO: 1228 - protein, 13 aa, Artificial Sequence
  Synthetic Peptide
RGGMSLRGQNLLR

SEQ ID NO: 1229 - protein, 13 aa, Artificial Sequence
  Synthetic Peptide
RGQNLLRGGRAVA

SEQ ID NO: 1230 - protein, 13 aa, Artificial Sequence
  Synthetic Peptide
NLLRGGRAVAPRM

SEQ ID NO: 1231 - protein, 13 aa, Artificial Sequence
  Synthetic Peptide
GRAVAPRMGLRRG

SEQ ID NO: 1232 - protein, 13 aa, Artificial Sequence
  Synthetic Peptide
RGRGRGRGALTRP

SEQ ID NO: 1233 - protein, 13 aa, Artificial Sequence
  Synthetic Peptide
GRGALTRPVLTKE

SEQ ID NO: 1234 - protein, 13 aa, Artificial Sequence
  Synthetic Peptide
GSQTPQRYPMTMQ

SEQ ID NO: 1235 - protein, 13 aa, Artificial Sequence
  Synthetic Peptide
AAGGFQRFAGQNQ

SEQ ID NO: 1236 - protein, 13 aa, Artificial Sequence
  Synthetic Peptide
DPMVMKRPQLYGM

SEQ ID NO: 1237 - protein, 13 aa, Artificial Sequence
  Synthetic Peptide
GPPGAQRYPLGMQ

SEQ ID NO: 1238 - protein, 13 aa, Artificial Sequence
  Synthetic Peptide
PLGMQGRAPGALG

SEQ ID NO: 1239 - protein, 13 aa, Artificial Sequence
  Synthetic Peptide
LSSPKIRFSILGL

SEQ ID NO: 1240 - protein, 13 aa, Artificial Sequence
  Synthetic Peptide
LFSPPPRHHLDPH

SEQ ID NO: 1241 - protein, 13 aa, Artificial Sequence
  Synthetic Peptide
DPHRIERLGAEEM

SEQ ID NO: 1242 - protein, 13 aa, Artificial Sequence
  Synthetic Peptide
SGLRNLREPIGPD

SEQ ID NO: 1243 - protein, 13 aa, Artificial Sequence
  Synthetic Peptide
  misc_feature (1)..(5): Xaa can be any naturally occurring amino acid
XXXXXMRILANKT

SEQ ID NO: 1244 - protein, 13 aa, Artificial Sequence
  Synthetic Peptide
FMTPRVREELLRH

SEQ ID NO: 1245 - protein, 13 aa, Artificial Sequence
  Synthetic Peptide
VREELLRHQLLEK

SEQ ID NO: 1246 - protein, 13 aa, Artificial Sequence
  Synthetic Peptide
FTSFQPRTATVTI

SEQ ID NO: 1247 - protein, 13 aa, Artificial Sequence
  Synthetic Peptide
TATVTIRPNTSAS

SEQ ID NO: 1248 - protein, 13 aa, Artificial Sequence
  Synthetic Peptide
ITGPQIRPGMTVI

SEQ ID NO: 1249 - protein, 13 aa, Artificial Sequence
  Synthetic Peptide
PGMTVIRTPLQQP

SEQ ID NO: 1250 - protein, 13 aa, Artificial Sequence
  Synthetic Peptide
RLQLGPRPPPVAV

SEQ ID NO: 1251 - protein, 13 aa, Artificial Sequence
  Synthetic Peptide
EKGQLFRLPSALN

SEQ ID NO: 1252 - protein, 13 aa, Artificial Sequence
  Synthetic Peptide
LPSALNRTSSDSA

SEQ ID NO: 1253 - protein, 13 aa, Artificial Sequence
  Synthetic Peptide
VPVEGSRYAADRR

SEQ ID NO: 1254 - protein, 13 aa, Artificial Sequence
  Synthetic Peptide
SRYAADRRRYRRG

SEQ ID NO: 1255 - protein, 13 aa, Artificial Sequence
  Synthetic Peptide
GARNQLRRPQYRP

SEQ ID NO: 1256 - protein, 13 aa, Artificial Sequence
  Synthetic Peptide
TQLQAHRNPTYRP

SEQ ID NO: 1257 - protein, 13 aa, Artificial Sequence
  Synthetic Peptide
HRNPTYRPRFRRG

SEQ ID NO: 1258 - protein, 13 aa, Artificial Sequence
  Synthetic Peptide
NPTYRPRFRRGPA

SEQ ID NO: 1259 - protein, 13 aa, Artificial Sequence
  Synthetic Peptide
PNQPSARRGFRRP

SEQ ID NO: 1260 - protein, 13 aa, Artificial Sequence
  Synthetic Peptide
NQPSARRGFRRPY

SEQ ID NO: 1261 - protein, 13 aa, Artificial Sequence
  Synthetic Peptide
PYNYRRRSRPLNA

SEQ ID NO: 1262 - protein, 13 aa, Artificial Sequence
  Synthetic Peptide
NYRRRSRPLNAVS

SEQ ID NO: 1263 - protein, 13 aa, Artificial Sequence
  Synthetic Peptide
RICEGIRPQIMNG

SEQ ID NO: 1264 - protein, 13 aa, Artificial Sequence
  Synthetic Peptide
RPPKMARYDNGSG

SEQ ID NO: 1265 - protein, 13 aa, Artificial Sequence
  Synthetic Peptide
ISPNSYRGNYGGG

SEQ ID NO: 1266 - protein, 13 aa, Artificial Sequence
  Synthetic Peptide
GGGGGYRGGSQGG

SEQ ID NO: 1267 - protein, 13 aa, Artificial Sequence
  Synthetic Peptide
NFGGDYRGSSGDY

SEQ ID NO: 1268 - protein, 13 aa, Artificial Sequence
  Synthetic Peptide
GSSGDYRGSGGGY

SEQ ID NO: 1269 - protein, 13 aa, Artificial Sequence
  Synthetic Peptide
SGGFQRRGYGGGY

SEQ ID NO: 1270 - protein, 13 aa, Artificial Sequence
  Synthetic Peptide
RVNSPPRFAGQRA

SEQ ID NO: 1271 - protein, 13 aa, Artificial Sequence
  Synthetic Peptide
LPYGGPRGPAPFP

SEQ ID NO: 1272 - protein, 13 aa, Artificial Sequence
  Synthetic Peptide
NEQPPSRFHFQGP

SEQ ID NO: 1273 - protein, 13 aa, Artificial Sequence
  Synthetic Peptide
PVKPPPRPLLELP

SEQ ID NO: 1274 - protein, 13 aa, Artificial Sequence
  Synthetic Peptide
EMFNSHRLGLDNS

SEQ ID NO: 1275 - protein, 13 aa, Artificial Sequence
  Synthetic Peptide
PQQCTFRFPSTAI

SEQ ID NO: 1276 - protein, 13 aa, Artificial Sequence
  Synthetic Peptide
SGGYEPRGRGGGR

SEQ ID NO: 1277 - protein, 13 aa, Artificial Sequence
  Synthetic Peptide
GYEPRGRGGGRGG

SEQ ID NO: 1278 - protein, 13 aa, Artificial Sequence
  Synthetic Peptide
RGRGGGRGGRGGM

SEQ ID NO: 1279 - protein, 13 aa, Artificial Sequence
  Synthetic Peptide
GGGRGGRGGMGGS

SEQ ID NO: 1280 - protein, 13 aa, Artificial Sequence
  Synthetic Peptide
GMGGSDRGGFNKF

SEQ ID NO: 1281 - protein, 13 aa, Artificial Sequence
  Synthetic Peptide
RGGPMGRGGYGGG

SEQ ID NO: 1282 - protein, 13 aa, Artificial Sequence
  Synthetic Peptide
GSGGGGRGGFPSG

SEQ ID NO: 1283 - protein, 13 aa, Artificial Sequence
  Synthetic Peptide
GSATAPRGVLHTF

SEQ ID NO: 1284 - protein, 13 aa, Artificial Sequence
  Synthetic Peptide
LALPSVRVGLSGP

SEQ ID NO: 1285 - protein, 13 aa, Artificial Sequence
  Synthetic Peptide
GKNQFNRGGGHRG

SEQ ID NO: 1286 - protein, 13 aa, Artificial Sequence
  Synthetic Peptide
NRGGGHRGRGGFN

SEQ ID NO: 1287 - protein, 13 aa, Artificial Sequence
  Synthetic Peptide
GGGHRGRGGFNMR

SEQ ID NO: 1288 - protein, 13 aa, Artificial Sequence
  Synthetic Peptide
RGGFNMRGGNFRG

SEQ ID NO: 1289 - protein, 13 aa, Artificial Sequence
  Synthetic Peptide
MRGGNFRGGAPGN

SEQ ID NO: 1290 - protein, 13 aa, Artificial Sequence
  Synthetic Peptide
GGAPGNRGGYNRR

SEQ ID NO: 1291 - protein, 13 aa, Artificial Sequence
  Synthetic Peptide
GPVFPGRGGYSNR

SEQ ID NO: 1292 - protein, 13 aa, Artificial Sequence
  Synthetic Peptide
RGGYSNRGNYNRG

SEQ ID NO: 1293 - protein, 13 aa, Artificial Sequence
  Synthetic Peptide
NRGNYNRGGMPNR

SEQ ID NO: 1294 - protein, 13 aa, Artificial Sequence
  Synthetic Peptide
RGGMPNRGNYNQN

SEQ ID NO: 1295 - protein, 13 aa, Artificial Sequence
  Synthetic Peptide
GGRFGSRGGPGGG

SEQ ID NO: 1296 - protein, 13 aa, Artificial Sequence
  Synthetic Peptide
GPGGGFRPFVPHI

SEQ ID NO: 1297 - protein, 13 aa, Artificial Sequence
  Synthetic Peptide
RGTPTPRGVLSTR

SEQ ID NO: 1298 - protein, 13 aa, Artificial Sequence
  Synthetic Peptide
RGVLSTRGPVSRG

SEQ ID NO: 1299 - protein, 13 aa, Artificial Sequence
  Synthetic Peptide
TRGPVSRGRGLLT

SEQ ID NO: 1300 - protein, 13 aa, Artificial Sequence
  Synthetic Peptide
GPVSRGRGLLTPR

SEQ ID NO: 1301 - protein, 13 aa, Artificial Sequence
  Synthetic Peptide
LPAGGPRVDPYRP

SEQ ID NO: 1302 - protein, 13 aa, Artificial Sequence
  Synthetic Peptide
PRVDPYRPVRLPM

SEQ ID NO: 1303 - protein, 13 aa, Artificial Sequence
  Synthetic Peptide
DPYRPVRLPMQKL

SEQ ID NO: 1304 - protein, 13 aa, Artificial Sequence
  Synthetic Peptide
TVPQGQRLRQQLQ

SEQ ID NO: 1305 - protein, 13 aa, Artificial Sequence
  Synthetic Peptide
PQGQRLRQQLQAK

SEQ ID NO: 1306 - protein, 13 aa, Artificial Sequence
  Synthetic Peptide
QQLKFVRAPMVVQ

SEQ ID NO: 1307 - protein, 13 aa, Artificial Sequence
  Synthetic Peptide
AVLANIRSPVFNH

SEQ ID NO: 1308 - protein, 13 aa, Artificial Sequence
  Synthetic Peptide
LLSGGPRGPVPQP

SEQ ID NO: 1309 - protein, 13 aa, Artificial Sequence
  Synthetic Peptide
GTPSPMRFTFPQG

SEQ ID NO: 1310 - protein, 13 aa, Artificial Sequence
  Synthetic Peptide
RLAMSARFPSTPG

SEQ ID NO: 1311 - protein, 13 aa, Artificial Sequence
  Synthetic Peptide
LQLQQQRMQLAQK

SEQ ID NO: 1312 - protein, 13 aa, Artificial Sequence
  Synthetic Peptide
PTVGQLRAQLQGV

SEQ ID NO: 1313 - protein, 13 aa, Artificial Sequence
  Synthetic Peptide
YMNVAKRPRFDFP

SEQ ID NO: 1314 - protein, 13 aa, Artificial Sequence
  Synthetic Peptide
NVAKRPRFDFPGS

SEQ ID NO: 1315 - protein, 13 aa, Artificial Sequence
  Synthetic Peptide
RLLMPSRGLANHG

SEQ ID NO: 1316 - protein, 13 aa, Artificial Sequence
  Synthetic Peptide
SALTQSRLSLNLK

SEQ ID NO: 1317 - protein, 13 aa, Artificial Sequence
  Synthetic Peptide
PRQTLNRPPAAPN

SEQ ID NO: 1318 - protein, 13 aa, Artificial Sequence
  Synthetic Peptide
AAPNQLRLQLQQR

SEQ ID NO: 1319 - protein, 13 aa, Artificial Sequence
  Synthetic Peptide
RLQLQQRLQGQQQ

SEQ ID NO: 1320 - protein, 13 aa, Artificial Sequence
  Synthetic Peptide
QLMHQNRQAILNQ

SEQ ID NO: 1321 - protein, 13 aa, Artificial Sequence
  Synthetic Peptide
PVGMNMRSGMQQQ

SEQ ID NO: 1322 - protein, 13 aa, Artificial Sequence
  Synthetic Peptide
SQQHRQRQIIQQQ

SEQ ID NO: 1323 - protein, 13 aa, Artificial Sequence
  Synthetic Peptide
QIIQQQRAMLMRH

SEQ ID NO: 1324 - protein, 13 aa, Artificial Sequence
  Synthetic Peptide
AFSQIYRFSLSDG

SEQ ID NO: 1325 - protein, 13 aa, Artificial Sequence
  Synthetic Peptide
AQKAALRMSQSTF

SEQ ID NO: 1326 - protein, 13 aa, Artificial Sequence
  Synthetic Peptide
STFNNPRPGQLGR

SEQ ID NO: 1327 - protein, 13 aa, Artificial Sequence
  Synthetic Peptide
TLRMQPRPGLRPT

SEQ ID NO: 1328 - protein, 13 aa, Artificial Sequence
  Synthetic Peptide
QPRPGLRPTGIVQ

SEQ ID NO: 1329 - protein, 13 aa, Artificial Sequence
  Synthetic Peptide
NQPNQLRLQLQHR

SEQ ID NO: 1330 - protein, 13 aa, Artificial Sequence
  Synthetic Peptide
LQAQQNRQPLMNQ

SEQ ID NO: 1331 - protein, 13 aa, Artificial Sequence
  Synthetic Peptide
NVNLTLRPGVPTQ

SEQ ID NO: 1332 - protein, 13 aa, Artificial Sequence
  Synthetic Peptide
MLAQRQREILNQH

SEQ ID NO: 1333 - protein, 13 aa, Artificial Sequence
  Synthetic Peptide
EPWNSVRVTFNIP

SEQ ID NO: 1334 - protein, 13 aa, Artificial Sequence
  Synthetic Peptide
NPMILSRAQLMPQ

SEQ ID NO: 1335 - protein, 13 aa, Artificial Sequence
  Synthetic Peptide
LGPSPQRMTPPKQ

SEQ ID NO: 1336 - protein, 13 aa, Artificial Sequence
  Synthetic Peptide
QDPKSIRLPVSQN

SEQ ID NO: 1337 - protein, 13 aa, Artificial Sequence
  Synthetic Peptide
QNVHPPRGPLNPD

SEQ ID NO: 1338 - protein, 13 aa, Artificial Sequence
  Synthetic Peptide
PSPDKQRMPMSVN

SEQ ID NO: 1339 - protein, 13 aa, Artificial Sequence
  Synthetic Peptide
PRPNLNRGFDQQG

SEQ ID NO: 1340 - protein, 13 aa, Artificial Sequence
  Synthetic Peptide
WRAAEPRYPPHGI

SEQ ID NO: 1341 - protein, 13 aa, Artificial Sequence
  Synthetic Peptide
AAYYLPRHLAPSP

SEQ ID NO: 1342 - protein, 13 aa, Artificial Sequence
  Synthetic Peptide
FSHPAIRYHPQET

SEQ ID NO: 1343 - protein, 13 aa, Artificial Sequence
  Synthetic Peptide
SQGSSPRMAFTHH

SEQ ID NO: 1344 - protein, 13 aa, Artificial Sequence
  Synthetic Peptide
PVLAGVRPGSPRA

SEQ ID NO: 1345 - protein, 13 aa, Artificial Sequence
  Synthetic Peptide
FTHPTIRYHHHHG

SEQ ID NO: 1346 - protein, 13 aa, Artificial Sequence
  Synthetic Peptide
PLSQASRYMGPQN

SEQ ID NO: 1347 - protein, 13 aa, Artificial Sequence
  Synthetic Peptide
RGSLLLRRGFSDS

SEQ ID NO: 1348 - protein, 13 aa, Artificial Sequence
  Synthetic Peptide
GRFLQPRLAPNQP

SEQ ID NO: 1349 - protein, 13 aa, Artificial Sequence
  Synthetic Peptide
PPPPLIRPALAAS

SEQ ID NO: 1350 - protein, 13 aa, Artificial Sequence
  Synthetic Peptide
PALAASRHSARPG

SEQ ID NO: 1351 - protein, 13 aa, Artificial Sequence
  Synthetic Peptide
PLQQQARFIQPRP

SEQ ID NO: 1352 - protein, 13 aa, Artificial Sequence
  Synthetic Peptide
ARFIQPRPTLNQP

SEQ ID NO: 1353 - protein, 13 aa, Artificial Sequence
  Synthetic Peptide
PPPPLIRPANSMP

SEQ ID NO: 1354 - protein, 13 aa, Artificial Sequence
  Synthetic Peptide
VPPQNPRPSLNSA

SEQ ID NO: 1355 - protein, 13 aa, Artificial Sequence
  Synthetic Peptide
PGHMMNRGGMSGR

SEQ ID NO: 1356 - protein, 13 aa, Artificial Sequence
  Synthetic Peptide
RGGMSGRGSFAPG

SEQ ID NO: 1357 - protein, 13 aa, Artificial Sequence
  Synthetic Peptide
APGGASRGHVIPR

SEQ ID NO: 1358 - protein, 13 aa, Artificial Sequence
  Synthetic Peptide
RGHVIPRGGMQAG

SEQ ID NO: 1359 - protein, 13 aa, Artificial Sequence
  Synthetic Peptide
GGLHDFRSPPPGM

SEQ ID NO: 1360 - protein, 13 aa, Artificial Sequence
  Synthetic Peptide
SGMDQSRKRPAPQ

SEQ ID NO: 1361 - protein, 13 aa, Artificial Sequence
  Synthetic Peptide
AGAPKGRGQFHGR

SEQ ID NO: 1362 - protein, 13 aa, Artificial Sequence
  Synthetic Peptide
ATTGAIRATLTPT

SEQ ID NO: 1363 - protein, 13 aa, Artificial Sequence
  Synthetic Peptide
KSRFAPRGAPHFR

SEQ ID NO: 1364 - protein, 13 aa, Artificial Sequence
  Synthetic Peptide
RGAPHFRFIIAGR

SEQ ID NO: 1365 - protein, 13 aa, Artificial Sequence
  Synthetic Peptide
RFIIAGRQAGRRC

SEQ ID NO: 1366 - protein, 13 aa, Artificial Sequence
  Synthetic Peptide
PFLGSARPRLRFS

SEQ ID NO: 1367 - protein, 13 aa, Artificial Sequence
  Synthetic Peptide
LGSARPRLRFSPY

SEQ ID NO: 1368 - protein, 13 aa, Artificial Sequence
  Synthetic Peptide
SARPRLRFSPYQI

SEQ ID NO: 1369 - protein, 13 aa, Artificial Sequence
  Synthetic Peptide
QQALRFRGPAPPP

SEQ ID NO: 1370 - protein, 13 aa, Artificial Sequence
  Synthetic Peptide
PPNAVMRGPPPLM

SEQ ID NO: 1371 - protein, 13 aa, Artificial Sequence
  Synthetic Peptide
HLENPTRYHLQQA

SEQ ID NO: 1372 - protein, 13 aa, Artificial Sequence
  Synthetic Peptide
RERNHPRVYQNRD

SEQ ID NO: 1373 - protein, 13 aa, Artificial Sequence
  Synthetic Peptide
GGYGNYRSNWQNY

SEQ ID NO: 1374 - protein, 13 aa, Artificial Sequence
  Synthetic Peptide
PNERGGRARGTFQ

SEQ ID NO: 1375 - protein, 13 aa, Artificial Sequence
  Synthetic Peptide
ERGGRARGTFQFR

SEQ ID NO: 1376 - protein, 13 aa, Artificial Sequence
  Synthetic Peptide
RGRGWGRGNYSGN

SEQ ID NO: 1377 - protein, 13 aa, Artificial Sequence
  Synthetic Peptide
GAFPRGRGRFMFR

SEQ ID NO: 1378 - protein, 13 aa, Artificial Sequence
  Synthetic Peptide
FPRGRGRFMFRKS

SEQ ID NO: 1379 - protein, 13 aa, Artificial Sequence
  Synthetic Peptide
KDWSQIRYPPPPV

SEQ ID NO: 1380 - protein, 13 aa, Artificial Sequence
  Synthetic Peptide
RVIDAVRFTLRQT

SEQ ID NO: 1381 - protein, 13 aa, Artificial Sequence
  Synthetic Peptide
KRRSILREPTFRW

SEQ ID NO: 1382 - protein, 13 aa, Artificial Sequence
  Synthetic Peptide
SFLEGPRGPRFDG

SEQ ID NO: 1383 - protein, 13 aa, Artificial Sequence
  Synthetic Peptide
EGPRGPRFDGPRR

SEQ ID NO: 1384 - protein, 13 aa, Artificial Sequence
  Synthetic Peptide
PRFDGPRRFEDLG

SEQ ID NO: 1385 - protein, 13 aa, Artificial Sequence
  Synthetic Peptide
PRPKGPRFEGNRP

SEQ ID NO: 1386 - protein, 13 aa, Artificial Sequence
  Synthetic Peptide
PRFEGNRPDGPRP

SEQ ID NO: 1387 - protein, 13 aa, Artificial Sequence
  Synthetic Peptide
NRPDGPRPRYESH

SEQ ID NO: 1388 - protein, 13 aa, Artificial Sequence
  Synthetic Peptide
PDGPRPRYESHPA

SEQ ID NO: 1389 - protein, 13 aa, Artificial Sequence
  Synthetic Peptide
GTQSSGRGGSLAR

SEQ ID NO: 1390 - protein, 13 aa, Artificial Sequence
  Synthetic Peptide
QGQPLPRQGIKRA

SEQ ID NO: 1391 - protein, 13 aa, Artificial Sequence
  Synthetic Peptide
PPYSQKRYEEIVK

SEQ ID NO: 1392 - protein, 13 aa, Artificial Sequence
  Synthetic Peptide
QKTAYQRNRMRFA

SEQ ID NO: 1393 - protein, 13 aa, Artificial Sequence
  Synthetic Peptide
TAYQRNRMRFAQR

SEQ ID NO: 1394 - protein, 13 aa, Artificial Sequence
  Synthetic Peptide
YQRNRMRFAQRNL

SEQ ID NO: 1395 - protein, 13 aa, Artificial Sequence
  Synthetic Peptide
RMRFAQRNLRRDK

SEQ ID NO: 1396 - protein, 13 aa, Artificial Sequence
  Synthetic Peptide
SRDDYRRDDRGPP

SEQ ID NO: 1397 - protein, 13 aa, Artificial Sequence
  Synthetic Peptide
NTPSQPRQHFYPS

SEQ ID NO: 1398 - protein, 13 aa, Artificial Sequence
  Synthetic Peptide
QHFYPSRAQPPSS

SEQ ID NO: 1399 - protein, 13 aa, Artificial Sequence
  Synthetic Peptide
RQTPGGRGVPLLN

SEQ ID NO: 1400 - protein, 13 aa, Artificial Sequence
  Synthetic Peptide
EEERAQRPRLQLK

SEQ ID NO: 1401 - protein, 13 aa, Artificial Sequence
  Synthetic Peptide
TFGIPLRPNRGRG

SEQ ID NO: 1402 - protein, 13 aa, Artificial Sequence
  Synthetic Peptide
HENEVLRHQLFAA

SEQ ID NO: 1403 - protein, 13 aa, Artificial Sequence
  Synthetic Peptide
FSVLPQRFPQFQQ

SEQ ID NO: 1404 - protein, 13 aa, Artificial Sequence
  Synthetic Peptide
FPGQAARYPWMAF

SEQ ID NO: 1405 - protein, 13 aa, Artificial Sequence
  Synthetic Peptide
PWMAFPRNSIMHL

SEQ ID NO: 1406 - protein, 13 aa, Artificial Sequence
  Synthetic Peptide
  misc_feature (12)..(13): Xaa can be any naturally occurring amino acid
GRSADSRLPFLXX

SEQ ID NO: 1407 - protein, 13 aa, Artificial Sequence
  Synthetic Peptide
FSRKSYRLTSDAE

SEQ ID NO: 1408 - protein, 13 aa, Artificial Sequence
  Synthetic Peptide
TLGRANRFLSTAA

SEQ ID NO: 1409 - protein, 13 aa, Artificial Sequence
  Synthetic Peptide
ERVESSRRAVSQI

SEQ ID NO: 1410 - protein, 13 aa, Artificial Sequence
  Synthetic Peptide
TSATLNRLTVPRY

SEQ ID NO: 1411 - protein, 13 aa, Artificial Sequence
  Synthetic Peptide
NRLTVPRYSIPTG

SEQ ID NO: 1412 - protein, 13 aa, Artificial Sequence
  Synthetic Peptide
ESPPLPRATLANR

SEQ ID NO: 1413 - protein, 13 aa, Artificial Sequence
  Synthetic Peptide
VPITGPRLTLALA

SEQ ID NO: 1414 - protein, 13 aa, Artificial Sequence
  Synthetic Peptide
YPAEPYRYPASPG

SEQ ID NO: 1415 - protein, 13 aa, Artificial Sequence
  Synthetic Peptide
SLRTLSRCSLLSA

SEQ ID NO: 1416 - protein, 13 aa, Artificial Sequence
  Synthetic Peptide
GSCPGIRQHLSGN

SEQ ID NO: 1417 - protein, 13 aa, Artificial Sequence
  Synthetic Peptide
VTQALSRFTSPQA

SEQ ID NO: 1418 - protein, 13 aa, Artificial Sequence
  Synthetic Peptide
YLPQPPRVDQALP

SEQ ID NO: 1419 - protein, 13 aa, Artificial Sequence
  Synthetic Peptide
TPSSASRYHRRRS

SEQ ID NO: 1420 - protein, 13 aa, Artificial Sequence
  Synthetic Peptide
PRPRALRFGSTAI

SEQ ID NO: 1421 - protein, 13 aa, Artificial Sequence
  Synthetic Peptide
TTRFTTRRSQSPI

SEQ ID NO: 1422 - protein, 13 aa, Artificial Sequence
  Synthetic Peptide
ASSAAFRYTAGTP

SEQ ID NO: 1423 - protein, 13 aa, Artificial Sequence
  Synthetic Peptide
GELLKCRQPVPPT

SEQ ID NO: 1424 - protein, 13 aa, Artificial Sequence
  Synthetic Peptide
PRLVFNRVNGRRP

SEQ ID NO: 1425 - protein, 13 aa, Artificial Sequence
  Synthetic Peptide
RARTATRGDMMNS

SEQ ID NO: 1426 - protein, 13 aa, Artificial Sequence
  Synthetic Peptide
LVDQLIRDLNELD

SEQ ID NO: 1427 - protein, 13 aa, Artificial Sequence
  Synthetic Peptide
NQQLPVRVPLRSG

SEQ ID NO: 1428 - protein, 13 aa, Artificial Sequence
  Synthetic Peptide
VPASCPRLPLRKT

SEQ ID NO: 1429 - protein, 13 aa, Artificial Sequence
  Synthetic Peptide
RGGNFGRGGNFGG

SEQ ID NO: 1430 - protein, 13 aa, Artificial Sequence
  Synthetic Peptide
GMPFVPRYVPEEP

SEQ ID NO: 1431 - protein, 13 aa, Artificial Sequence
  Synthetic Peptide
AFSRIARVGFLSR

SEQ ID NO: 1432 - protein, 13 aa, Artificial Sequence
  Synthetic Peptide
GFLSRGRGVLFLG

SEQ ID NO: 1433 - protein, 13 aa, Artificial Sequence
  Synthetic Peptide
RSYCPARPGQRRV

SEQ ID NO: 1434 - protein, 13 aa, Artificial Sequence
  Synthetic Peptide
GVGVGGRGTLRAL

SEQ ID NO: 1435 - protein, 13 aa, Artificial Sequence
  Synthetic Peptide
GGRGTLRALRPGV

SEQ ID NO: 1436 - protein, 13 aa, Artificial Sequence
  Synthetic Peptide
DWGSSGRGGYQHV

SEQ ID NO: 1437 - protein, 13 aa, Artificial Sequence
  Synthetic Peptide
GGYQHVRGEESWK

SEQ ID NO: 1438 - protein, 13 aa, Artificial Sequence
  Synthetic Peptide
GQSTFLRFNHPAE

SEQ ID NO: 1439 - protein, 13 aa, Artificial Sequence
  Synthetic Peptide
SLPPPPRGRGYIR

SEQ ID NO: 1440 - protein, 13 aa, Artificial Sequence
  Synthetic Peptide
PPPPRGRGYIRGG

SEQ ID NO: 1441 - protein, 13 aa, Artificial Sequence
  Synthetic Peptide
RGRGYIRGGLGPR

SEQ ID NO: 1442 - protein, 13 aa, Artificial Sequence
  Synthetic Peptide
RNPRRLRSWSLVK

SEQ ID NO: 1443 - protein, 13 aa, Artificial Sequence
  Synthetic Peptide
SVGAPRRVPPPGS

SEQ ID NO: 1444 - protein, 13 aa, Artificial Sequence
  Synthetic Peptide
RPDFRPREAFLGR

SEQ ID NO: 1445 - protein, 13 aa, Artificial Sequence
  Synthetic Peptide
REAFLGRDPFHSL

SEQ ID NO: 1446 - protein, 13 aa, Artificial Sequence
  Synthetic Peptide
PFFAPKRPFFPPR

SEQ ID NO: 1447 - protein, 13 aa, Artificial Sequence
  Synthetic Peptide
  misc_feature (9)..(13): Xaa can be any naturally occurring amino acid
RPFFPPRYXXXXX

SEQ ID NO: 1448 - protein, 13 aa, Artificial Sequence
  Synthetic Peptide
IGGVSPRHALTSP

SEQ ID NO: 1449 - protein, 13 aa, Artificial Sequence
  Synthetic Peptide
SLGGQGRQNLWFA

SEQ ID NO: 1450 - protein, 13 aa, Artificial Sequence
  Synthetic Peptide
HFPVPIRQPLKAT

SEQ ID NO: 1451 - protein, 13 aa, Artificial Sequence
  Synthetic Peptide
KIAQPVRSFLQPP

SEQ ID NO: 1452 - protein, 13 aa, Artificial Sequence
  Synthetic Peptide
VGRNLNRFSCFVR

SEQ ID NO: 1453 - protein, 13 aa, Artificial Sequence
  Synthetic Peptide
PTFPQFRTQYIRR

SEQ ID NO: 1454 - protein, 13 aa, Artificial Sequence
  Synthetic Peptide
VPGLVPRFAVPEP

SEQ ID NO: 1455 - protein, 13 aa, Artificial Sequence
  Synthetic Peptide
AEKLGVRFPGPGG

SEQ ID NO: 1456 - protein, 13 aa, Artificial Sequence
  Synthetic Peptide
IRQRSMRYQQNRL

SEQ ID NO: 1457 - protein, 13 aa, Artificial Sequence
  Synthetic Peptide
VAEVEKRNRLKLL

SEQ ID NO: 1458 - protein, 13 aa, Artificial Sequence
  Synthetic Peptide
GAEQQRRQPVFIS

SEQ ID NO: 1459 - protein, 13 aa, Artificial Sequence
  Synthetic Peptide
FAQPMMRPPFGAA

SEQ ID NO: 1460 - protein, 13 aa, Artificial Sequence
  Synthetic Peptide
ESTVRRRYSDFEW

SEQ ID NO: 1461 - protein, 13 aa, Artificial Sequence
  Synthetic Peptide
LRGGPQCLSSLVR

SEQ ID NO: 1462 - protein, 17 aa, Artificial Sequence
  Synthetic Peptide
EGGRGGISSGGEGVQDR

SEQ ID NO: 1463 - protein, 8 aa, Artificial Sequence
  Synthetic Peptide
GSLDGFLR

SEQ ID NO: 1464 - protein, 26 aa, Artificial Sequence
  Synthetic Peptide
SDPFMPPSASEPLSTTWNELNYMGGR

SEQ ID NO: 1465 - protein, 16 aa, Artificial Sequence
  Synthetic Peptide
QGVGGFGGTMPYGCGR

SEQ ID NO: 1466 - protein, 18 aa, Artificial Sequence
  Synthetic Peptide
KDPLSGLLLLPAMLEGYR

SEQ ID NO: 1467 - protein, 16 aa, Artificial Sequence
  Synthetic Peptide
LRGPGGPRGGPSGGMR

SEQ ID NO: 1468 - protein, 10 aa, Artificial Sequence
  Synthetic Peptide
GALPVPPIAR

SEQ ID NO: 1469 - protein, 24 aa, Artificial Sequence
  Synthetic Peptide
HTGQTVRLTLMRKGASQEAELTSR

SEQ ID NO: 1470 - protein, 15 aa, Artificial Sequence
  Synthetic Peptide
YLPRRQLHGESPTRR

SEQ ID NO: 1471 - protein, 26 aa, Artificial Sequence
  Synthetic Peptide
RSGTDQITNMLIHETWASSIEALMRK

SEQ ID NO: 1472 - protein, 10 aa, Artificial Sequence
  Synthetic Peptide
RRQEREQQLR

SEQ ID NO: 1473 - protein, 12 aa, Artificial Sequence
  Synthetic Peptide
VAQPVRGCGLPR

SEQ ID NO: 1474 - protein, 17 aa, Artificial Sequence
  Synthetic Peptide
SGSNWGRGSNMNSGPPR

SEQ ID NO: 1475 - protein, 9 aa, Artificial Sequence
  Synthetic Peptide
GMTVYGLPR

SEQ ID NO: 1476 - protein, 9 aa, Artificial Sequence
  Synthetic Peptide
QLFLQTYAR

SEQ ID NO: 1477 - protein, 7 aa, Artificial Sequence
  Synthetic Peptide
IEHYASR

SEQ ID NO: 1478 - protein, 17 aa, Artificial Sequence
  Synthetic Peptide
FILADGASQGMAAFRPR

SEQ ID NO: 1479 - protein, 9 aa, Artificial Sequence
  Synthetic Peptide
QRKDELEQR

SEQ ID NO: 1480 - protein, 20 aa, Artificial Sequence
  Synthetic Peptide
TQGRGGPASVPSASPGTSVK

SEQ ID NO: 1481 - protein, 17 aa, Artificial Sequence
  Synthetic Peptide
SQRPSVSDDTEHLVNGR

SEQ ID NO: 1482 - protein, 10 aa, Artificial Sequence
  Synthetic Peptide
MGLEALRGGR

SEQ ID NO: 1483 - protein, 15 aa, Artificial Sequence
  Synthetic Peptide
AHRPSPQNLHNDRGK

SEQ ID NO: 1484 - protein, 15 aa, Artificial Sequence
  Synthetic Peptide
LLMPSRGLANHGQTR

SEQ ID NO: 1485 - protein, 10 aa, Artificial Sequence
  Synthetic Peptide
GGPISFSSSR

SEQ ID NO: 1486 - protein, 27 aa, Artificial Sequence
  Synthetic Peptide
SSSMSVTGRGGPRPVSSSIDPSLLSTK

SEQ ID NO: 1487 - protein, 17 aa, Artificial Sequence
  Synthetic Peptide
DTNSTTAAAPPSPLKRR

SEQ ID NO: 1488 - protein, 25 aa, Artificial Sequence
  Synthetic Peptide
HVIGLQMGSNRGASQAGMTGYGRPR

SEQ ID NO: 1489 - protein, 8 aa, Artificial Sequence
  Synthetic Peptide
GPSAPAPR

SEQ ID NO: 1490 - protein, 17 aa, Artificial Sequence
  Synthetic Peptide
DNDSGGSRPPILPPGGR

SEQ ID NO: 1491 - protein, 16 aa, Artificial Sequence
  Synthetic Peptide
PGGDREPVGAATALAR

SEQ ID NO: 1492 - protein, 33 aa, Artificial Sequence
  Synthetic Peptide
GRGGAPAETTWPGEGAGGDGYYPSGGAWAEASR

SEQ ID NO: 1493 - protein, 11 aa, Artificial Sequence
  Synthetic Peptide
RTFSDLAAQLH

SEQ ID NO: 1494 - protein, 32 aa, Artificial Sequence
  Synthetic Peptide
RGGGAASAQARPPKEEPAFSWSCSEFGLSDIR

SEQ ID NO: 1495 - protein, 20 aa, Artificial Sequence
  Synthetic Peptide
DPIVALPFEAGDYYVPRGGR

SEQ ID NO: 1496 - protein, 21 aa, Artificial Sequence
  Synthetic Peptide
RDPIVALPFEAGDYYVPRGGR

SEQ ID NO: 1497 - protein, 21 aa, Artificial Sequence
  Synthetic Peptide
LQVTYNCRAPQSGTIQNQYLR

SEQ ID NO: 1498 - protein, 11 aa, Artificial Sequence
  Synthetic Peptide
DRDWFPDQGYR

SEQ ID NO: 1499 - protein, 13 aa, Artificial Sequence
  Synthetic Peptide
DRDWFPDQGYRGR

SEQ ID NO: 1500 - protein, 10 aa, Artificial Sequence
  Synthetic Peptide
GRGEYYSRGR

SEQ ID NO: 1501 - protein, 13 aa, Artificial Sequence
  Synthetic Peptide
LNGQQPALASQYR

SEQ ID NO: 1502 - protein, 20 aa, Artificial Sequence
  Synthetic Peptide
QRAEVLQSTQRFFSEQQQNK

SEQ ID NO: 1503 - protein, 27 aa, Artificial Sequence
  Synthetic Peptide
SLRGRGPPPSWASEPERPSILSASELK

SEQ ID NO: 1504 - protein, 24 aa, Artificial Sequence
  Synthetic Peptide
GRGPPPSWASEPERPSILSASELK

SEQ ID NO: 1505 - protein, 13 aa, Artificial Sequence
  Synthetic Peptide
VIGRGGCNINAIR

SEQ ID NO: 1506 - protein, 12 aa, Artificial Sequence
  Synthetic Peptide
STVDPPAPSAGR

SEQ ID NO: 1507 - protein, 14 aa, Artificial Sequence
  Synthetic Peptide
GEAHLAVNDFDLAR

SEQ ID NO: 1508 - protein, 24 aa, Artificial Sequence
  Synthetic Peptide
GMYQSVAGGMQPPPLQRAPPPTVR

SEQ ID NO: 1509 - protein, 19 aa, Artificial Sequence
  Synthetic Peptide
YFQHLCNDLEVFASHAGRK

SEQ ID NO: 1510 - protein, 8 aa, Artificial Sequence
  Synthetic Peptide
RPSGNGGF

SEQ ID NO: 1511 - protein, 14 aa, Artificial Sequence
  Synthetic Peptide
RPRRLCTLPNYTKR

SEQ ID NO: 1512 - protein, 8 aa, Artificial Sequence
  Synthetic Peptide
SMMSSYER

SEQ ID NO: 1513 - protein, 21 aa, Artificial Sequence
  Synthetic Peptide
LGHDAYRLGQDPYRLGHDPYR

SEQ ID NO: 1514 - protein, 16 aa, Artificial Sequence
  Synthetic Peptide
HYLLRGGGGPAATLSR

SEQ ID NO: 1515 - protein, 16 aa, Artificial Sequence
  Synthetic Peptide
QVEQAVQTAPYRGGPR

SEQ ID NO: 1516 - protein, 16 aa, Artificial Sequence
  Synthetic Peptide
QVEQAVQTAPYRGGPR

SEQ ID NO: 1517 - protein, 28 aa, Artificial Sequence
  Synthetic Peptide
YLGQGLQYGSFTDLRHPTDLLSHPLPLR

SEQ ID NO: 1518 - protein, 23 aa, Artificial Sequence
  Synthetic Peptide
AWNTEDDLPVYLARPGSAAQTPR

SEQ ID NO: 1519 - protein, 10 aa, Artificial Sequence
  Synthetic Peptide
LQGLQGAGGR

SEQ ID NO: 1520 - protein, 21 aa, Artificial Sequence
  Synthetic Peptide
VGRGASLCAVQPAVAECGPAR

SEQ ID NO: 1521 - protein, 12 aa, Artificial Sequence
  Synthetic Peptide
LREQQEEMVELR

SEQ ID NO: 1522 - protein, 25 aa, Artificial Sequence
  Synthetic Peptide
SGGGGGGRFSGGGFCGSSGSGFGSK

SEQ ID NO: 1523 - protein, 20 aa, Artificial Sequence
  Synthetic Peptide
VRPASSAASVYAGAGGSGSR

SEQ ID NO: 1524 - protein, 27 aa, Artificial Sequence
  Synthetic Peptide
IGSGGVFRAPSIHGGSGGRGVSVSSTR

SEQ ID NO: 1525 - protein, 32 aa, Artificial Sequence
  Synthetic Peptide
APSIHGGSGGRGVSVSSTRFVTSSSGSYGGVR

SEQ ID NO: 1526 - protein, 32 aa, Artificial Sequence; identical to SEQ ID NO: 1525
  Synthetic Peptide

SEQ ID NO: 1527 - protein, 11 aa, Artificial Sequence
  Synthetic Peptide
QFSSQSAFSSR

SEQ ID NO: 1528 - protein, 9 aa, Artificial Sequence
  Synthetic Peptide
SIFGNLVGR

SEQ ID NO: 1529 - protein, 15 aa, Artificial Sequence
  Synthetic Peptide
GFSAHSACSAFSGAR

SEQ ID NO: 1530 - protein, 33 aa, Artificial Sequence
  Synthetic Peptide
GSGGQVTIPGRGSGGQVTIPGRGSGGQVTVPGR

SEQ ID NO: 1531 - protein, 7 aa, Artificial Sequence
  Synthetic Peptide
MSTSGPR

SEQ ID NO: 1532 - protein, 27 aa, Artificial Sequence
  Synthetic Peptide
VTPSANSSLSSSGELGQPSGEQMLQAR

SEQ ID NO: 1533 - protein, 16 aa, Artificial Sequence
  Synthetic Peptide
QREEEEDKMLETMIKK

SEQ ID NO: 1534 - protein, 26 aa, Artificial Sequence
  Synthetic Peptide
SLSVLSPRQPTPNREPTSLAGPSQFR

SEQ ID NO: 1535 - protein, 31 aa, Artificial Sequence
  Synthetic Peptide
RRPPPPARGGGSGGGGGGSSSSSSSSQQQLR

SEQ ID NO: 1536 - protein, 14 aa, Artificial Sequence
  Synthetic Peptide
GPLRPFVPEQELLR

SEQ ID NO: 1537 - protein, 11 aa, Artificial Sequence
  Synthetic Peptide
RFELRPGSGGR

SEQ ID NO: 1538 - protein, 13 aa, Artificial Sequence
  Synthetic Peptide
LVGRGVGPVSQFK

SEQ ID NO: 1539 - protein, 9 aa, Artificial Sequence
  Synthetic Peptide
TCFPLAGLR

SEQ ID NO: 1540 - protein, 24 aa, Artificial Sequence
  Synthetic Peptide
HTMHVGRGGDVFGDTSFLSNHGGR

SEQ ID NO: 1541 - protein, 10 aa, Artificial Sequence
  Synthetic Peptide
KFEDRFEEER

SEQ ID NO: 1542 - protein, 23 aa, Artificial Sequence
  Synthetic Peptide
FVSCLLEQPEVSVTGAGRGHAGR

SEQ ID NO: 1543 - protein, 34 aa, Artificial Sequence
  Synthetic Peptide
SSGRQNLRLQSDSSSSTQVFESVDEVEQTEAEGR

SEQ ID NO: 1544 - protein, 24 aa, Artificial Sequence
  Synthetic Peptide
MHPASVTTTSQDPCAPSGSCRGGR

SEQ ID NO: 1545 - protein, 9 aa, Artificial Sequence
  Synthetic Peptide
VSAHTRAVR

SEQ ID NO: 1546 - protein, 27 aa, Artificial Sequence
  Synthetic Peptide
DSEAKIIQQAGQVWFPDSAYKTAQVIR

SEQ ID NO: 1547 - protein, 14 aa, Artificial Sequence
  Synthetic Peptide
ESHVATAPPDICSR

SEQ ID NO: 1548 - protein, 19 aa, Artificial Sequence
  Synthetic Peptide
FQQLLLCLVEVRALSMQAK

SEQ ID NO: 1549 - protein, 14 aa, Artificial Sequence
  Synthetic Peptide
SQEESICAMFYLPR

SEQ ID NO: 1550 - protein, 11 aa, Artificial Sequence
  Synthetic Peptide
AAGRGWGLGGR

SEQ ID NO: 1551 - protein, 14 aa, Artificial Sequence
  Synthetic Peptide
GGGAGEQPPPPSAR

SEQ ID NO: 1552 - protein, 25 aa, Artificial Sequence
  Synthetic Peptide
ITQYLDAGGIPRTAQSEETRVWHRR

SEQ ID NO: 1553 - protein, 17 aa, Artificial Sequence
  Synthetic Peptide
LHRGAPANVSSSDLTGR

SEQ ID NO: 1554 - protein, 17 aa, Artificial Sequence
  Synthetic Peptide
YDQAQFGRGRGWQPFHK

SEQ ID NO: 1555 - protein, 20 aa, Artificial Sequence
  Synthetic Peptide
PMSDDVQDEEVPQSRPILYR

SEQ ID NO: 1556 - protein, 11 aa, Artificial Sequence
  Synthetic Peptide
RGSFSSENYWR

SEQ ID NO: 1557 - protein, 14 aa, Artificial Sequence
  Synthetic Peptide
SPADTRLPAFLSLR

SEQ ID NO: 1558 - protein, 21 aa, Artificial Sequence
  Synthetic Peptide
VTQSPGTVIPPLPPPSSVLPR

SEQ ID NO: 1559 - protein, 7 aa, Artificial Sequence
  Synthetic Peptide
GQILWFR

SEQ ID NO: 1560 - protein, 17 aa, Artificial Sequence
  Synthetic Peptide
GPHHLDNSSPGPGSEAR

SEQ ID NO: 1561 - protein, 20 aa, Artificial Sequence
  Synthetic Peptide
HTLHVGRGGDAFGDTSFLSR

SEQ ID NO: 1562 - protein, 30 aa, Artificial Sequence
  Synthetic Peptide
KPPAAPQQPQPPAPHPPQHPQNQAHRGGHR

SEQ ID NO: 1563 - protein, 12 aa, Artificial Sequence
  Synthetic Peptide
AARSLVMRTGLR

SEQ ID NO: 1564 - protein, 6 aa, Artificial Sequence
  Synthetic Peptide
NISIVR

SEQ ID NO: 1565 - protein, 11 aa, Artificial Sequence
  Synthetic Peptide
MGAGMGFGLER

SEQ ID NO: 1566 - protein, 21 aa, Artificial Sequence
  Synthetic Peptide
ERFAQTMEFVEEYLRDVVCQR

SEQ ID NO: 1567 - protein, 15 aa, Artificial Sequence
  Synthetic Peptide
TRPEVGRWLERCLSR

SEQ ID NO: 1568 - protein, 20 aa, Artificial Sequence
  Synthetic Peptide
ATAVPLSGNGVPFGGAGGGR

SEQ ID NO: 1569 - protein, 24 aa, Artificial Sequence
  Synthetic Peptide
RTFGMAEEYHRESMLVEWEQVKQR

SEQ ID NO: 1570 - protein, 8 aa, Artificial Sequence
  Synthetic Peptide
YMRPTSSR

SEQ ID NO: 1571 - protein, 17 aa, Artificial Sequence
  Synthetic Peptide
YIRVVHARVINFSWAWR

SEQ ID NO: 1572 - protein, 14 aa, Artificial Sequence
  Synthetic Peptide
ASHYLIQVYTGYRR

SEQ ID NO: 1573 - protein, 17 aa, Artificial Sequence
  Synthetic Peptide
SPALAFSLAATAQAAPR

SEQ ID NO: 1574 - protein, 21 aa, Artificial Sequence
  Synthetic Peptide
SVIDQRIHLFLKCCFVLGVQR

SEQ ID NO: 1575 - protein, 30 aa, Artificial Sequence
  Synthetic Peptide
VSAGRGSMSSGLEFVSHNPPSEAAAPPVAR

SEQ ID NO: 1576 - protein, 24 aa, Artificial Sequence
  Synthetic Peptide
GGGSCSGSVGGGGSGSLPSQRGGR

SEQ ID NO: 1577 - protein, 24 aa, Artificial Sequence
  Synthetic Peptide
GGGSCSGSVGGGGSGSLPSQRGGR

SEQ ID NO: 1578 - protein, 14 aa, Artificial Sequence
  Synthetic Peptide
SGGYGGSRDYYASR

SEQ ID NO: 1579 - protein, 10 aa, Artificial Sequence
  Synthetic Peptide
GPPLDARGGR

SEQ ID NO: 1580 - protein, 10 aa, Artificial Sequence
  Synthetic Peptide
RNDYDGIGGR

SEQ ID NO: 1581 - protein, 34 aa, Artificial Sequence
  Synthetic Peptide
SWGNNNYPQQRPEPYYQQQYTQYGHNQRPPYGYY

SEQ ID NO: 1582 - protein, 11 aa, Artificial Sequence
  Synthetic Peptide
EDIHAGGGGAR

SEQ ID NO: 1583 - protein, 10 aa, Artificial Sequence
  Synthetic Peptide
QEMQEVQSSR

SEQ ID NO: 1584 - protein, 22 aa, Artificial Sequence
  Synthetic Peptide
QEMQSAGSQRGRGGGSGNFMGR

SEQ ID NO: 1585 - protein, 24 aa, Artificial Sequence
  Synthetic Peptide
LLGQRPGPYDRPIGGRGGYYGAGR

SEQ ID NO: 1586 - protein, 19 aa, Artificial Sequence
  Synthetic Peptide
GGGGGSGGGGGNYRGGFNR

SEQ ID NO: 1587 - protein, 18 aa, Artificial Sequence
  Synthetic Peptide
LDVSSYSFDPLLALYAPR

SEQ ID NO: 1588 - protein, 7 aa, Artificial Sequence
  Synthetic Peptide
SQTGWPR

SEQ ID NO: 1589 - protein, 19 aa, Artificial Sequence
  Synthetic Peptide
GDDGRGGGSGGTNHPSAPR

SEQ ID NO: 1590 - protein, 24 aa, Artificial Sequence
  Synthetic Peptide
SHADDVGLVLSSLQASIYRGGYNR

SEQ ID NO: 1591 - protein, 24 aa, Artificial Sequence
  Synthetic Peptide
SHADDVGLVLSSLQASIYRGGYNR

SEQ ID NO: 1592 - protein, 14 aa, Artificial Sequence
  Synthetic Peptide
SQGGYDRYSGGNYR

SEQ ID NO: 1593 - protein, 12 aa, Artificial Sequence
  Synthetic Peptide
GSRGGAFGGRGR

SEQ ID NO: 1594 - protein, 36 aa, Artificial Sequence
  Synthetic Peptide
QSSGDGVSCAASDYLVGQVADSLRGGPRPPGGGTGR

SEQ ID NO: 1595 - protein, 9 aa, Artificial Sequence
  Synthetic Peptide
RSAPSGPVR

SEQ ID NO: 1596 - protein, 10 aa, Artificial Sequence
  Synthetic Peptide
RGLPPPPRSR

SEQ ID NO: 1597 - protein, 10 aa, Artificial Sequence
  Synthetic Peptide
RGLPPPPRSR

SEQ ID NO: 1598 - protein, 24 aa, Artificial Sequence
  Synthetic Peptide
RSVSLTPPMNVPNQPLGHGWMSHE

SEQ ID NO: 1599 - protein, 28 aa, Artificial Sequence
  Synthetic Peptide
KPANDITSQLEINFGDLGRPGRGGRGGR

SEQ ID NO: 1600 - protein, 25 aa, Artificial Sequence
  Synthetic Peptide
VAAPVGPVVPTPTVLPMGAPVPRPR

SEQ ID NO: 1601 - protein, 27 aa, Artificial Sequence
  Synthetic Peptide
IALALTAISLGTARPPPSMSAAGLAAR

SEQ ID NO: 1602 - protein, 17 aa, Artificial Sequence
  Synthetic Peptide
GYGGSQGGGRGRGGYDK

SEQ ID NO: 1603 - protein, 15 aa, Artificial Sequence
  Synthetic Peptide
GPMTGSSGGDRGGFK

SEQ ID NO: 1604 - protein, 11 aa, Artificial Sequence
  Synthetic Peptide
SVRGWGTQDSR

SEQ ID NO: 1605 - protein, 9 aa, Artificial Sequence
  Synthetic Peptide
QYEMGECTR

SEQ ID NO: 1606 - protein, 27 aa, Artificial Sequence
  Synthetic Peptide
MIQNQNAAFQPNQYQMLGGPGGYPPRR

SEQ ID NO: 1607 - protein, 13 aa, Artificial Sequence
  Synthetic Peptide
AAFAPGAAALAPR

SEQ ID NO: 1608 - protein, 14 aa, Artificial Sequence
  Synthetic Peptide
RSLRLFEPFEVHTR

SEQ ID NO: 1609 - protein, 14 aa, Artificial Sequence
  Synthetic Peptide
EVEEGELEIVPVRR

SEQ ID NO: 1610 - protein, 25 aa, Artificial Sequence
  Synthetic Peptide
AAGPGLGSVAMGPRQHYPYGGPYDR

SEQ ID NO: 1611 - protein, 39 aa, Artificial Sequence
  Synthetic Peptide
VGIPSGLGAECPSQPPLHGIHIADNNPFNLLRIPGSVSR

SEQ ID NO: 1612 - protein, 39 aa, Artificial Sequence; identical to SEQ ID NO: 1611
  Synthetic Peptide

SEQ ID NO: 1613 - protein, 8 aa, Artificial Sequence
  Synthetic Peptide
EVAPRSKR

SEQ ID NO: 1614 - protein, 20 aa, Artificial Sequence
  Synthetic Peptide
ARGGWPGAEATPSLPLGGSR

SEQ ID NO: 1615 - protein, 22 aa, Artificial Sequence
  Synthetic Peptide
GMAGSPSRGGIWQSSIVHYMNR

SEQ ID NO: 1616 - protein, 13 aa, Artificial Sequence
  Synthetic Peptide
VLVPLAAPSMSVR

SEQ ID NO: 1617 - protein, 25 aa, Artificial Sequence
  Synthetic Peptide
GAEAANVTGPDGVPVEGSRYAADRR

SEQ ID NO: 1618 - protein, 6 aa, Artificial Sequence
  Synthetic Peptide
YAADRR

SEQ ID NO: 1619 - protein, 19 aa, Artificial Sequence
  Synthetic Peptide
GNYGGGGGGYRGGSQGGYR

SEQ ID NO: 1620 - protein, 23 aa, Artificial Sequence
  Synthetic Peptide
VWNNGSSLQASSQLSRGSATAPR

SEQ ID NO: 1621 - protein, 34 aa, Artificial Sequence
  Synthetic Peptide
MLPHAPGVQMQAIPEDAIPEESGDEDEEDPDKRI

SEQ ID NO: 1622 - protein, 17 aa, Artificial Sequence
  Synthetic Peptide
GGNFRGGAPGNRGGYNR

SEQ ID NO: 1623 - protein, 21 aa, Artificial Sequence
  Synthetic Peptide
HSAYSYCGRGFYPQYGALETR

SEQ ID NO: 1624 - protein, 23 aa, Artificial Sequence
  Synthetic Peptide
GVTGVDLYRGHIPLAFDPTSIPR

SEQ ID NO: 1625 - protein, 22 aa, Artificial Sequence
  Synthetic Peptide
NSASGPGWYGANPDPRFPAISR

SEQ ID NO: 1626 - protein, 9 aa, Artificial Sequence
  Synthetic Peptide
TLRGGATVK

SEQ ID NO: 1627 - protein, 14 aa, Artificial Sequence
  Synthetic Peptide
QDQQQPDRPFNRGK

SEQ ID NO: 1628 - protein, 22 aa, Artificial Sequence
  Synthetic Peptide
TPIYLQPDTYSSLDRAPSPRPR

SEQ ID NO: 1629 - protein, 22 aa, Artificial Sequence
  Synthetic Peptide
TPIYLQPDTYSSLDRAPSPRPR

SEQ ID NO: 1630 - protein, 25 aa, Artificial Sequence
  Synthetic Peptide
QTTADWWWGERAGCCGYIPANHLGK

SEQ ID NO: 1631 - protein, 32 aa, Artificial Sequence
  Synthetic Peptide
GGINTYIPLIIPGFPYPTAATTAAAFRGAHLR

SEQ ID NO: 1632 - protein, 32 aa, Artificial Sequence
  Synthetic Peptide
AVPPTAIPAYPGVVYQDGFYGADLYGGYAAYR

SEQ ID NO: 1633 - protein, 26 aa, Artificial Sequence
  Synthetic Peptide
VYTADPYHALAPAASYGVGAVASLYR

SEQ ID NO: 1634 - protein, 17 aa, Artificial Sequence
  Synthetic Peptide
TPGSCYPHLPRGQGAYR

SEQ ID NO: 1635 - protein, 14 aa, Artificial Sequence
  Synthetic Peptide
GMGPGTPAGYGRGR

SEQ ID NO: 1636 - protein, 23 aa, Artificial Sequence
  Synthetic Peptide
ENEGKPENKGRAEDEGSTEEGGK

SEQ ID NO: 1637 - protein, 30 aa, Artificial Sequence
  Synthetic Peptide
ASSSHHTSSGTSLSAIHSSGSSGRGAGPLK

SEQ ID NO: 1638 - protein, 20 aa, Artificial Sequence
  Synthetic Peptide
ASGTEAADFALPSSRGGPGK

SEQ ID NO: 1639 - protein, 7 aa, Artificial Sequence
  Synthetic Peptide
FPPYYMR

SEQ ID NO: 1640 - protein, 11 aa, Artificial Sequence
  Synthetic Peptide
LRPGFMEDRGR

SEQ ID NO: 1641 - protein, 22 aa, Artificial Sequence
  Synthetic Peptide
ENYSSYSSFSSPHMKPAPVGSR

SEQ ID NO: 1642 - protein, 13 aa, Artificial Sequence
  Synthetic Peptide
GRTNTISMTGGLR

SEQ ID NO: 1643 - protein, 13 aa, Artificial Sequence
  Synthetic Peptide
IPSTVCFGQGAAR

SEQ ID NO: 1644 - protein, 18 aa, Artificial Sequence
  Synthetic Peptide
HGLPLGTQSSGRGGSLAR

SEQ ID NO: 1645 - protein, 37 aa, Artificial Sequence
  Synthetic Peptide
SSGGGRGGGAGGGGGGSGGGGGGGGGGGGGGGGGGSR

SEQ ID NO: 1646 - protein, 17 aa, Artificial Sequence
  Synthetic Peptide
GGPGGELPRGPAGLGPR

SEQ ID NO: 1647 - protein, 12 aa, Artificial Sequence
  Synthetic Peptide
SLGRGLFVDPAR

SEQ ID NO: 1648 - protein, 12 aa, Artificial Sequence
  Synthetic Peptide
APAPPAMHAVPR

SEQ ID NO: 1649 - protein, 24 aa, Artificial Sequence
  Synthetic Peptide
LDMSHGFVHHIRRNQLDRDDYDKK

SEQ ID NO: 1650 - protein, 10 aa, Artificial Sequence
  Synthetic Peptide
LALGSRGGYN

SEQ ID NO: 1651 - protein, 30 aa, Artificial Sequence
  Synthetic Peptide
SCYSVGYGNSGFRPLNCGVYGFPSLSYGSR

SEQ ID NO: 1652 - protein, 10 aa, Artificial Sequence
  Synthetic Peptide
YCSPIYFASR

SEQ ID NO: 1653 - protein, 21 aa, Artificial Sequence
  Synthetic Peptide
RGGQSGRPSMTSTIGSNAQGK

SEQ ID NO: 1654 - protein, 14 aa, Artificial Sequence
  Synthetic Peptide
FRGTQYPESGGLDR

SEQ ID NO: 1655 - protein, 26 aa, Artificial Sequence
  Synthetic Peptide
AAVAGAGRGGGGGGGGGGAADPGQER

SEQ ID NO: 1656 - protein, 22 aa, Artificial Sequence
  Synthetic Peptide
MPPSRLSGIMVPAPIQDLEALR

SEQ ID NO: 1657 - protein, 13 aa, Artificial Sequence
  Synthetic Peptide
TSPSLTPTRGTPR

SEQ ID NO: 1658 - protein, 23 aa, Artificial Sequence
  Synthetic Peptide
PFSGLPLSGSADFLQPPPAFAGR

SEQ ID NO: 1659 - protein, 13 aa, Artificial Sequence
  Synthetic Peptide
PGVRGAPSSPGGR

SEQ ID NO: 1660 - protein, 20 aa, Artificial Sequence
  Synthetic Peptide
GAPRLPTVCGDFLLDYPLDR

SEQ ID NO: 1661 - protein, 47 aa, Artificial Sequence
  Synthetic Peptide
LGVSPAQNTHLLSTLGGGGRGGGGGGGPGPSPEAYLVGNQQAWLALR

SEQ ID NO: 1662 - protein, 27 aa, Artificial Sequence
  Synthetic Peptide
AGVGRASQGWEDGAGEQLRGGPGGRGR

SEQ ID NO: 1663 - protein, 22 aa, Artificial Sequence
  Synthetic Peptide
ASQGWEDGAGEQLRGGPGGRGR

SEQ ID NO: 1664 - protein, 26 aa, Artificial Sequence
  Synthetic Peptide
SGPAGSSGGRGGAGGPGPGIGGPAGR

SEQ ID NO: 1665 - protein, 8 aa, Artificial Sequence
  Synthetic Peptide
WSYYAITR

SEQ ID NO: 1666 - protein, 8 aa, Artificial Sequence
  Synthetic Peptide
LLRKLLSR

SEQ ID NO: 1667 - protein, 16 aa, Artificial Sequence
  Synthetic Peptide
GGGSWGPGRGGAGGLR

SEQ ID NO: 1668 - protein, 29 aa, Artificial Sequence
  Synthetic Peptide
ITRGSAPLPPPPLPPAAFGAYSGGAGPSR

SEQ ID NO: 1669 - protein, 40 aa, Artificial Sequence
  Synthetic Peptide
SLINQGADSGAHRTFIPELHTPKMSQGPTLLSCGIMENDR

SEQ ID NO: 1670 - protein, 13 aa, Artificial Sequence
  Synthetic Peptide
ATIDAMSSYSSDR

SEQ ID NO: 1671 - protein, 28 aa, Artificial Sequence
  Synthetic Peptide
HMPGQPPYMRPPGMILPPGLPPGQIPSR

SEQ ID NO: 1672 - protein, 42 aa, Artificial Sequence
  Synthetic Peptide
PESSAGRGTGRHPPLHSDFSAEPGLPSCIPVGQSQGTALLLH

SEQ ID NO: 1673 - protein, 27 aa, Artificial Sequence
  Synthetic Peptide
SHVTSTPIPRPPAPLETSPTFAVSENR

SEQ ID NO: 1674 - protein, 15 aa, Artificial Sequence
  Synthetic Peptide
RTPGPPHARRPRASR

SEQ ID NO: 1675 - protein, 16 aa, Artificial Sequence
  Synthetic Peptide
TTGLVGLAVCDSPHER

SEQ ID NO: 1676 - protein, 19 aa, Artificial Sequence
  Synthetic Peptide
LTCLLNSCAPHNREGAIMR

SEQ ID NO: 1677 - protein, 19 aa, Artificial Sequence
  Synthetic Peptide
ECLLHACPSPFGKGREALR

SEQ ID NO: 1678 - protein, 8 aa, Artificial Sequence
  Synthetic Peptide
LRSWSLVK

SEQ ID NO: 1679 - protein, 19 aa, Artificial Sequence
  Synthetic Peptide
NNWIFIDEEQAFGGRGQAR

SEQ ID NO: 1680 - protein, 19 aa, Artificial Sequence
  Synthetic Peptide
NNWIFIDEEQAFGGRGQAR

SEQ ID NO: 1681 - protein, 14 aa, Artificial Sequence
  Synthetic Peptide
PHLWQRDRASGVRR

SEQ ID NO: 1682 - protein, 10 aa, Artificial Sequence
  Synthetic Peptide
AVTLSGGRGR

SEQ ID NO: 1683 - protein, 39 aa, Artificial Sequence
  Synthetic Peptide
KAAEEVGCSSLAAAMLSPPSMILMQRAKSFLEYCISLNK

SEQ ID NO: 1684 - protein, 16 aa, Artificial Sequence
  Synthetic Peptide
SHKPEPPVAGPGRGGR

SEQ ID NO: 1685 - protein, 8 aa, Artificial Sequence
  Synthetic Peptide
FIHGPSPR

SEQ ID NO: 1686 - protein, 16 aa, Artificial Sequence
  Synthetic Peptide
VGSKHGGSAAPALCSR

SEQ ID NO: 1687 - protein, 35 aa, Artificial Sequence
  Synthetic Peptide
LITKPQNLNDAYGPPSNFLEIDVSNPQTVGVGRGR

SEQ ID NO: 1688 - protein, 13 aa, Artificial Sequence
  Synthetic Peptide
AAGQSFSQGTTGR

SEQ ID NO: 1689 - protein, 21 aa, Artificial Sequence
  Synthetic Peptide
LPAPPRGGSPLTTTQGGSPTK

SEQ ID NO: 1690 - protein, 17 aa, Artificial Sequence
  Synthetic Peptide
LQRGGSAPEGAAYAAPR

SEQ ID NO: 1691 - protein, 14 aa, Artificial Sequence
  Synthetic Peptide
GGSAPEGAAYAAPR

SEQ ID NO: 1692 - protein, 15 aa, Artificial Sequence
  Synthetic Peptide
GRGFSIVTDTPELQR

SEQ ID NO: 1693 - protein, 15 aa, Artificial Sequence
  Synthetic Peptide
GRGFTPVVDDPVTER

SEQ ID NO: 1694 - protein, 9 aa, Artificial Sequence
  Synthetic Peptide
LGAARGQLR

SEQ ID NO: 1695 - protein, 11 aa, Artificial Sequence
  Synthetic Peptide
SQSDLSSASSR

SEQ ID NO: 1696 - protein, 21 aa, Artificial Sequence
  Synthetic Peptide
TNPPTQKPPSPPVSGRGTLGR

SEQ ID NO: 1697 - protein, 16 aa, Artificial Sequence
  Synthetic Peptide
AGPRRSHSSSEASEHR

SEQ ID NO: 1698 - protein, 10 aa, Artificial Sequence
  Synthetic Peptide
MRGGDTFGPR

SEQ ID NO: 1699 - protein, 16 aa, Artificial Sequence
  Synthetic Peptide
MRGGDTFGPRAQGWAR

SEQ ID NO: 1700 - protein, 34 aa, Artificial Sequence
  Synthetic Peptide
EHCSRLLGNGGPQASARPVPPRERGSLPVIEGTR

SEQ ID NO: 1701 - protein, 10 aa, Artificial Sequence
  Synthetic Peptide
NPGGRGGNPR

SEQ ID NO: 1702 - protein, 30 aa, Artificial Sequence
  Synthetic Peptide
VSHYIINSSGPRPPVPPSPAQPPPGVSPSR

SEQ ID NO: 1703 - protein, 8 aa, Artificial Sequence
  Synthetic Peptide
ELSVIDGR

SEQ ID NO: 1704 - protein, 8 aa, Artificial Sequence
  Synthetic Peptide
EAFSTEPR

SEQ ID NO: 1705 - protein, 14 aa, Artificial Sequence
  Synthetic Peptide
DGFSTLQFPRGEAK

SEQ ID NO: 1706 - protein, 10 aa, Artificial Sequence
  Synthetic Peptide
ARGESPGRIR

SEQ ID NO: 1707 - protein, 18 aa, Artificial Sequence
  Synthetic Peptide
RGSWSTLTLSHAHEVCQK

SEQ ID NO: 1708 - protein, 27 aa, Artificial Sequence
  Synthetic Peptide
ADAGRGNGPLPLGGSGLMEEMSALLAR

SEQ ID NO: 1709 - protein, 16 aa, Artificial Sequence
  Synthetic Peptide
LRGPGGPRGGPSGGMR

SEQ ID NO: 1710 - protein, 30 aa, Artificial Sequence
  Synthetic Peptide
SCLYGAGLLPGSLPFGPLLAAPGSARGGAR

SEQ ID NO: 1711 - protein, 30 aa, Artificial Sequence; identical to SEQ ID NO: 1710
  Synthetic Peptide

SEQ ID NO: 1712 - protein, 25 aa, Artificial Sequence
  Synthetic Peptide
VSLRNMTLLATIMSGSTMSLNHEAP

SEQ ID NO: 1713 - protein, 14 aa, Artificial Sequence
  Synthetic Peptide
GRGGAVPPPPPPGR

SEQ ID NO: 1714 - protein, 16 aa, Artificial Sequence
  Synthetic Peptide
GTTVTRGALPVPPIAR

SEQ ID NO: 1715 - protein, 16 aa, Artificial Sequence
  Synthetic Peptide
GTTVTRGALPVPPIAR

SEQ ID NO: 1716 - protein, 24 aa, Artificial Sequence
  Synthetic Peptide
ATFSSMSGLDSVSDSGEGRGSPLR

SEQ ID NO: 1717 - protein, 23 aa, Artificial Sequence
  Synthetic Peptide
SAQPSPHYMAGPSSGQIYGPGPR

SEQ ID NO: 1718 - protein, 15 aa, Artificial Sequence
  Synthetic Peptide
SLGISIVGGRGMGSR

SEQ ID NO: 1719 - protein, 15 aa, Artificial Sequence
  Synthetic Peptide
KPPGAQLGFNIRGGK

SEQ ID NO: 1720 - protein, 11 aa, Artificial Sequence
  Synthetic Peptide
VPGTHTPPIRR

SEQ ID NO: 1721 - protein, 25 aa, Artificial Sequence
  Synthetic Peptide
YSQAPTLPSGAPLDPYGAGSGRAGK

SEQ ID NO: 1722 - protein, 9 aa, Artificial Sequence
  Synthetic Peptide
LSRGGGTLK

SEQ ID NO: 1723 - protein, 40 aa, Artificial Sequence
  Synthetic Peptide
EELLSFMGAEEAAPDPAGVGRGGGAAGLTSGGGGQPQWQK

SEQ ID NO: 1724 - protein, 13 aa, Artificial Sequence
  Synthetic Peptide
QLRPTGQLRGGLK

SEQ ID NO: 1725 - protein, 45 aa, Artificial Sequence
  Synthetic Peptide
LALGPQPSLRGWRGGGPSPTSGAPSPSHHSSSGGSSGPAQAPALR

SEQ ID NO: 1726 - protein, 35 aa, Artificial Sequence
  Synthetic Peptide
GWRGGGPSPTSGAPSPSHHSSSGGSSGPAQAPALR

SEQ ID NO: 1727 - protein, 32 aa, Artificial Sequence
  Synthetic Peptide
GGGPSPTSGAPSPSHHSSSGGSSGPAQAPALR

SEQ ID NO: 1728 - protein, 18 aa, Artificial Sequence
  Synthetic Peptide
YFQLPPRAASAAMYVPAR

SEQ ID NO: 1729 - protein, 13 aa, Artificial Sequence
  Synthetic Peptide
HEPVLRLWGDPAR

SEQ ID NO: 1730 - protein, 13 aa, Artificial Sequence
  Synthetic Peptide
ELGYRAGLGSQEK

SEQ ID NO: 1731 - protein, 18 aa, Artificial Sequence
  Synthetic Peptide
LQQFGGASTAGGALPWAR

SEQ ID NO: 1732 - protein, 26 aa, Artificial Sequence
  Synthetic Peptide
VSPAPRPSSLPILPSGPLYPGLFDIR

SEQ ID NO: 1733 - protein, 20 aa, Artificial Sequence
  Synthetic Peptide
PSSLPILPSGPLYPGLFDIR

SEQ ID NO: 1734 - protein, 38 aa, Artificial Sequence
  Synthetic Peptide
SSPTGGAGGSADPFAPVFVPPHPGISGGLGGALSGASR

SEQ ID NO: 1735 - protein, 20 aa, Artificial Sequence
  Synthetic Peptide
GPQGTRGRGSGAPGNLASTR

SEQ ID NO: 1736 - protein, 14 aa, Artificial Sequence
  Synthetic Peptide
GRGSGAPGNLASTR

SEQ ID NO: 1737 - protein, 22 aa, Artificial Sequence
  Synthetic Peptide
DGPAGGTGGSGGPGGSLGSRGR

SEQ ID NO: 1738 - protein, 35 aa, Artificial Sequence
  Synthetic Peptide
LTPSPRGGPFNPGSGGPLPASSPSSFDGPSPPDPR

SEQ ID NO: 1739 - protein, 20 aa, Artificial Sequence
  Synthetic Peptide
DGELENDISGPSAGRGGHNK

SEQ ID NO: 1740 - protein, 13 aa, Artificial Sequence
  Synthetic Peptide
KENEVRSNRLFTK

SEQ ID NO: 1741 - protein, 17 aa, Artificial Sequence
  Synthetic Peptide
NRPPFGQGYAQPGPGYR

SEQ ID NO: 1742 - protein, 41 aa, Artificial Sequence
  Synthetic Peptide
EPGPGVPEGPSGVHIPAGGGRGGGHEPQGPLGQPPEEELER

SEQ ID NO: 1743 - protein, 14 aa, Artificial Sequence
  Synthetic Peptide
SMRGGYIGSTYFER

SEQ ID NO: 1744 - protein, 20 aa, Artificial Sequence
  Synthetic Peptide
GPPPPGRGGPPPPPPPATGR

SEQ ID NO: 1745 - protein, 11 aa, Artificial Sequence
  Synthetic Peptide
GRGAPPPPPSR

SEQ ID NO: 1746 - protein, 16 aa, Artificial Sequence
  Synthetic Peptide
LREFEGRGGPLPQEEK

SEQ ID NO: 1747 - protein, 14 aa, Artificial Sequence
  Synthetic Peptide
EFEGRGGPLPQEEK

SEQ ID NO: 1748 - protein, 12 aa, Artificial Sequence
  Synthetic Peptide
EFNEGDGRGAAR

SEQ ID NO: 1749 - protein, 27 aa, Artificial Sequence
  Synthetic Peptide
GRDNFPGPDDFGPEEGFDASDEAARGR

SEQ ID NO: 1750 - protein, 25 aa, Artificial Sequence
  Synthetic Peptide
DNFPGPDDFGPEEGFDASDEAARGR

SEQ ID NO: 1751 - protein, 10 aa, Artificial Sequence
  Synthetic Peptide
GRGGPGPSQR

SEQ ID NO: 1752 - protein, 14 aa, Artificial Sequence
  Synthetic Peptide
RHEQSGGPEHGPDR

SEQ ID NO: 1753 - protein, 28 aa, Artificial Sequence
  Synthetic Peptide
GPVRGLAPPPPTSATPSLLSNRPPPPAR

SEQ ID NO: 1754 - protein, 30 aa, Artificial Sequence
  Synthetic Peptide
TPGPVRGLAPPPPTSATPSLLSNRPPPPAR

SEQ ID NO: 1755 - protein, 17 aa, Artificial Sequence
  Synthetic Peptide
EPPSRGAAPPPPPPMIR

SEQ ID NO: 1756 - protein, 13 aa, Artificial Sequence
  Synthetic Peptide
AARGAPPLPPILR

SEQ ID NO: 1757 - protein, 16 aa, Artificial Sequence
  Synthetic Peptide
RGAHTTVSQPQPSPSK

SEQ ID NO: 1758 - protein, 21 aa, Artificial Sequence
  Synthetic Peptide
NLHQSGFSLSGAQIDDNIPRR

SEQ ID NO: 1759 - protein, 15 aa, Artificial Sequence
  Synthetic Peptide
IVAPPGGRANITSLG

SEQ ID NO: 1760 - protein, 20 aa, Artificial Sequence
  Synthetic Peptide
TQGRGGPASVPSASPGTSVK

SEQ ID NO: 1761 - protein, 21 aa, Artificial Sequence
  Synthetic Peptide
SAMGSSLYALESGSDFKSRGR

SEQ ID NO: 1762 - protein, 19 aa, Artificial Sequence
  Synthetic Peptide
TAALCFQVVSQTPGRWDRR

SEQ ID NO: 1763 - protein, 18 aa, Artificial Sequence
  Synthetic Peptide
ALAEPEPEIYWVTPAGVR

SEQ ID NO: 1764 - protein, 18 aa, Artificial Sequence
  Synthetic Peptide
LLPVKQLAGGMVSLKSGR

SEQ ID NO: 1765 - protein, 25 aa, Artificial Sequence
  Synthetic Peptide
DLPLDPREFLPGHTPFRPPGSLGPR

SEQ ID NO: 1766 - protein, 21 aa, Artificial Sequence
  Synthetic Peptide
YLFVDRAVIYNPATQADWTAK

SEQ ID NO: 1767 - protein, 11 aa, Artificial Sequence
  Synthetic Peptide
RGGPISFSSSR

SEQ ID NO: 1768 - protein, 11 aa, Artificial Sequence
  Synthetic Peptide
RGGPISFSSSR

SEQ ID NO: 1769 - protein, 14 aa, Artificial Sequence
  Synthetic Peptide
RGGPISFSSSRSGR

SEQ ID NO: 1770 - protein, 14 aa, Artificial Sequence
  Synthetic Peptide
RGGPISFSSSRSGR

SEQ ID NO: 1771 - protein, 14 aa, Artificial Sequence
  Synthetic Peptide
RGGPISFSSSRSGR

SEQ ID NO: 1772 - protein, 17 aa, Artificial Sequence
  Synthetic Peptide
KMMERRESIFCIQYNVR

SEQ ID NO: 1773 - protein, 16 aa, Artificial Sequence
  Synthetic Peptide
PGPVPEAAQSFLYAPR

SEQ ID NO: 1774 - protein, 8 aa, Artificial Sequence
  Synthetic Peptide
PTSFVTVR

SEQ ID NO: 1775 - protein, 28 aa, Artificial Sequence
  Synthetic Peptide
IREPSEEEVVVTVEKPPAAEPTYPTWKR

SEQ ID NO: 1776 - protein, 13 aa, Artificial Sequence
  Synthetic Peptide
SEILGLRQAGTAR

SEQ ID NO: 1777 - protein, 18 aa, Artificial Sequence
  Synthetic Peptide
GYYSPYSVSGSGSTAGSR

SEQ ID NO: 1778 - protein, 22 aa, Artificial Sequence
  Synthetic Peptide
GYYSPYSVSGSGSTAGSRTGSR

SEQ ID NO: 1779 - protein, 27 aa, Artificial Sequence
  Synthetic Peptide
RGSFDATGSGFSMTFSSSSYSSSGYGR

SEQ ID NO: 1780 - protein, 9 aa, Artificial Sequence
  Synthetic Peptide
AELEQMRLR

SEQ ID NO: 1781 - protein, 14 aa, Artificial Sequence
  Synthetic Peptide
MIFFSDGFSSNMFR

SEQ ID NO: 1782 - protein, 16 aa, Artificial Sequence
  Synthetic Peptide
DPSSSSSMSSRGSGSR

SEQ ID NO: 1783 - protein, 11 aa, Artificial Sequence
  Synthetic Peptide
KADVLRGSHQR

SEQ ID NO: 1784 - protein, 8 aa, Artificial Sequence
  Synthetic Peptide
RVQNQRRR

SEQ ID NO: 1785 - protein, 19 aa, Artificial Sequence
  Synthetic Peptide
GRGGPCSPPSPDELPANVK

SEQ ID NO: 1786 - protein, 18 aa, Artificial Sequence
  Synthetic Peptide
GGGLRLPLLQPETPVSLR

SEQ ID NO: 1787 - protein, 16 aa, Artificial Sequence
  Synthetic Peptide
GRGAANDSTQFTVAGR

SEQ ID NO: 1788 - protein, 14 aa, Artificial Sequence
  Synthetic Peptide
DTGSEVEAHGVSHR

SEQ ID NO: 1789 - protein, 18 aa, Artificial Sequence
  Synthetic Peptide
DTGSEVEAHGVSHRGGWR

SEQ ID NO: 1790 - protein, 23 aa, Artificial Sequence
  Synthetic Peptide
HVIGLQMGSNRGASQAGMTGYGR

SEQ ID NO: 1791 - protein, 25 aa, Artificial Sequence
  Synthetic Peptide
HVIGLQMGSNRGASQAGMTGYGRPR

SEQ ID NO: 1792 - protein, 28 aa, Artificial Sequence
  Synthetic Peptide
SDVATVNWNAPSQAFPLITQLLGLPTYR

SEQ ID NO: 1793 - protein, 7 aa, Artificial Sequence
  Synthetic Peptide
IYDLRGK

SEQ ID NO: 1794 - protein, 12 aa, Artificial Sequence
  Synthetic Peptide
TGSEVIGRGGPR

SEQ ID NO: 1795 - protein, 12 aa, Artificial Sequence
  Synthetic Peptide
TGSEVIGRGGPR

SEQ ID NO: 1796 - protein, 27 aa, Artificial Sequence
  Synthetic Peptide
FWEVISDEHGIDPTGSYHGDSDLQLER

SEQ ID NO: 1797 - protein, 20 aa, Artificial Sequence
  Synthetic Peptide
IFRPDNFVFGQSGAGNNWAK

SEQ ID NO: 1798 - protein, 17 aa, Artificial Sequence
  Synthetic Peptide
DNDSGGSRPPILPPGGR

SEQ ID NO: 1799 - protein, 21 aa, Artificial Sequence
  Synthetic Peptide
HPLLSPGGPQSPLRGSTGSLK

SEQ ID NO: 1800 - protein, 13 aa, Artificial Sequence
  Synthetic Peptide
AAHGRGALAEAAR

SEQ ID NO: 1801 - protein, 13 aa, Artificial Sequence
  Synthetic Peptide
WEPGGRGGGASTR

SEQ ID NO: 1802 - protein, 17 aa, Artificial Sequence
  Synthetic Peptide
SQSPLRGGMTEAAQTDK

SEQ ID NO: 1803 - protein, 27 aa, Artificial Sequence
  Synthetic Peptide
GYIPIPVIHEQNITRPAAQPSFHQAQK

SEQ ID NO: 1804 - protein, 9 aa, Artificial Sequence
  Synthetic Peptide
PLRAASPFR

SEQ ID NO: 1805 - protein, 9 aa, Artificial Sequence
  Synthetic Peptide
SPVRGASSR

SEQ ID NO: 1806 - protein, 32 aa, Artificial Sequence; identical to SEQ ID NO: 1494
  Synthetic Peptide

SEQ ID NO: 1807 - protein, 22 aa, Artificial Sequence
  Synthetic Peptide
RGGGAAGGASGVSGAGAAGGGR

SEQ ID NO: 1808 - protein, 29 aa, Artificial Sequence
  Synthetic Peptide
RGGGAAGGASGVSGAGAAGGGRGTGQLNR

SEQ ID NO: 1809 - protein, 28 aa, Artificial Sequence
  Synthetic Peptide
GGGAAGGASGVSGAGAAGGGRGTGQLNR

SEQ ID NO: 1810 - protein, 28 aa, Artificial Sequence
  Synthetic Peptide
GGGAAGGASGVSGAGAAGGGRGTGQLNR

SEQ ID NO: 1811 - protein, 31 aa, Artificial Sequence
  Synthetic Peptide
QLQVISSSCGSTPSASLGRGGGGSASGPGVR

SEQ ID NO: 1812 - protein, 13 aa, Artificial Sequence
  Synthetic Peptide
LSARPEGGSGRGR

SEQ ID NO: 1813 - protein, 19 aa, Artificial Sequence
  Synthetic Peptide
TLAFRGGGGGGLGNNGSSR

SEQ ID NO: 1814 - protein, 7 aa, Artificial Sequence
  Synthetic Peptide
PVETPSR

SEQ ID NO: 1815 - protein, 20 aa, Artificial Sequence
  Synthetic Peptide
QNLAARGGFVQILTKPSFPK

SEQ ID NO: 1816 - protein, 10 aa, Artificial Sequence
  Synthetic Peptide
IGGGRGGPSR

SEQ ID NO: 1817 - protein, 11 aa, Artificial Sequence
  Synthetic Peptide
SMSVAASCWGR

SEQ ID NO: 1818 - protein, 38 aa, Artificial Sequence
  Synthetic Peptide
YPLGDGCSTLLADVLQTHNTVFQEHAAPSSPGTAPAGR

SEQ ID NO: 1819 - protein, 41 aa, Artificial Sequence
  Synthetic Peptide
YPLGDGCSTLLADVLQTHNTVFQEHAAPSSPGTAPAGRGFR

SEQ ID NO: 1820 - protein, 22 aa, Artificial Sequence
  Synthetic Peptide
ATYRGGLEGQSSISMTDPQFLK

SEQ ID NO: 1821 - protein, 27 aa, Artificial Sequence
  Synthetic Peptide
VTIQQFQSPLPIQIPSSQATRGPQPGR

SEQ ID NO: 1822 - protein, 18 aa, Artificial Sequence
  Synthetic Peptide
SRGGTGSVSGAGLEPVAR

SEQ ID NO: 1823 - protein, 8 aa, Artificial Sequence
  Synthetic Peptide
RVSSVPSR

SEQ ID NO: 1824 - protein, 27 aa, Artificial Sequence
  Synthetic Peptide
VSSVPSRAQSPSYVTSTGVSPSRGSLR

SEQ ID NO: 1825 - protein, 32 aa, Artificial Sequence
  Synthetic Peptide
TSLGSGFGSPSVTDSRPLNPSAYSSSTLPAQR

SEQ ID NO: 1826 - protein, 32 aa, Artificial Sequence; identical to SEQ ID NO: 1825
  Synthetic Peptide

SEQ ID NO: 1827 - protein, 19 aa, Artificial Sequence
  Synthetic Peptide
QSSGSTTNVASTPSDSRGR

SEQ ID NO: 1828 - protein, 19 aa, Artificial Sequence
  Synthetic Peptide
QSSGSTTNVASTPSDSRGR

SEQ ID NO: 1829 - protein, 15 aa, Artificial Sequence
  Synthetic Peptide
GFTPLDRFGLGQSGR

SEQ ID NO: 1830 - protein, 13 aa, Artificial Sequence
  Synthetic Peptide
SQARMSSGAPQGR

SEQ ID NO: 1831 - protein, 43 aa, Artificial Sequence
  Synthetic Peptide
GGPGRGGGGGFTAPVGGPDGIVPMPMPMPMPSPNAPFAYPLPK

SEQ ID NO: 1832 - protein, 15 aa, Artificial Sequence
  Synthetic Peptide
DGYGSPHHTPPCGPR

SEQ ID NO: 1833 - protein, 21 aa, Artificial Sequence
  Synthetic Peptide
RDPIVALPFEAGDYYVPRGGR

SEQ ID NO: 1834 - protein, 20 aa, Artificial Sequence
  Synthetic Peptide
DPIVALPFEAGDYYVPRGGR

SEQ ID NO: 1835 - protein, 19 aa, Artificial Sequence
  Synthetic Peptide
TRAGAGGGGGAVGPQPSAK

SEQ ID NO: 1836 - protein, 22 aa, Artificial Sequence
  Synthetic Peptide
HQEQAATSSTHHRGGHGVPHGK

SEQ ID NO: 1837 - protein, 22 aa, Artificial Sequence
  Synthetic Peptide
YMELYTHVYNYCTSVHQSNQAR

SEQ ID NO: 1838 - protein, 11 aa, Artificial Sequence
  Synthetic Peptide
GRGDYDGIGGR

SEQ ID NO: 1839 - protein, 14 aa, Artificial Sequence
  Synthetic Peptide
GRGDYDGIGGRGDR

SEQ ID NO: 1840 - protein, 14 aa, Artificial Sequence
  Synthetic Peptide
GRGDYDGIGGRGDR

SEQ ID NO: 1841 - protein, 12 aa, Artificial Sequence
  Synthetic Peptide
GDYDGIGGRGDR

SEQ ID NO: 1842 - protein, 14 aa, Artificial Sequence
  Synthetic Peptide
QSSGASSSSFSSSR

SEQ ID NO: 1843 - protein, 40 aa, Artificial Sequence
  Synthetic Peptide
SGGGGHGGSRGFGGGGYGGFYNSDGYGGNYNSQGVDWWGN

SEQ ID NO: 1844 - protein, 12 aa, Artificial Sequence
  Synthetic Peptide
SSFFGDRGSGSR

SEQ ID NO: 1845 - protein, 14 aa, Artificial Sequence
  Synthetic Peptide
SSFFGDRGSGSRGR

SEQ ID NO: 1846 - protein, 14 aa, Artificial Sequence
  Synthetic Peptide
SSFFGDRGSGSRGR

SEQ ID NO: 1847 - protein, 12 aa, Artificial Sequence
  Synthetic Peptide
SSFFGDRGSGSR

SEQ ID NO: 1848 - protein, 15 aa, Artificial Sequence
  Synthetic Peptide
FDDRGRGDYDGIGGR

SEQ ID NO: 1849 - protein, 18 aa, Artificial Sequence
  Synthetic Peptide
GRTASPVNSPARGTPSPK

SEQ ID NO: 1850 - protein, 16 aa, Artificial Sequence
  Synthetic Peptide
TASPVNSPARGTPSPK

SEQ ID NO: 1851 - protein, 11 aa, Artificial Sequence
  Synthetic Peptide
TSGPASGRGTK

SEQ ID NO: 1852 - protein, 26 aa, Artificial Sequence
  Synthetic Peptide
IYHPVRYYYIQNVYTPVDEHVYPGHR

SEQ ID NO: 1853 - protein, 21 aa, Artificial Sequence
  Synthetic Peptide
LQVTYNCRAPQSGTIQNQYLR

SEQ ID NO: 1854 - protein, 13 aa, Artificial Sequence
  Synthetic Peptide
APQSGTIQNQYLR

SEQ ID NO: 1855 - protein, 19 aa, Artificial Sequence
  Synthetic Peptide
GPCGSLSGVRGNQAQAALK

SEQ ID NO: 1856 - protein, 24 aa, Artificial Sequence
  Synthetic Peptide
GRGPPPSWASEPERPSILSASELK

SEQ ID NO: 1857 - protein, 16 aa, Artificial Sequence
  Synthetic Peptide
IGGEVGRGQDASYAGK

SEQ ID NO: 1858 - protein, 27 aa, Artificial Sequence
  Synthetic Peptide
AALAAGLPLRPFPTAGGRGGAAATIAR

SEQ ID NO: 1859 - protein, 26 aa, Artificial Sequence
  Synthetic Peptide
MIDLHPHLNTHGPPHTLQPDRASPSR

SEQ ID NO: 1860 - protein, 15 aa, Artificial Sequence
  Synthetic Peptide
SFDEVEGVFGRGGGR

SEQ ID NO: 1861 - protein, 15 aa, Artificial Sequence
  Synthetic Peptide
SFDEVEGVFGRGGGR

SEQ ID NO: 1862 - protein, 18 aa, Artificial Sequence
  Synthetic Peptide
LTGRGGGGGTVVGAPRGR

SEQ ID NO: 1863 - protein, 14 aa, Artificial Sequence
  Synthetic Peptide
GGGGGTVVGAPRGR

SEQ ID NO: 1864 - protein, 25 aa, Artificial Sequence
  Synthetic Peptide
KGPGPGGPGGAGGARGGAGGGPSGD

SEQ ID NO: 1865 - protein, 21 aa, Artificial Sequence
  Synthetic Peptide
MAQRPYQMPQLPVAVPQQGLR

SEQ ID NO: 1866 - protein, 12 aa, Artificial Sequence
  Synthetic Peptide
SLLRSPSWEPFR

SEQ ID NO: 1867 - protein, 14 aa, Artificial Sequence
  Synthetic Peptide
PPAPSAGRGRGQAR

SEQ ID NO: 1868 - protein, 18 aa, Artificial Sequence
  Synthetic Peptide
STVDPPAPSAGRGRGQAR

SEQ ID NO: 1869 - protein, 20 aa, Artificial Sequence
  Synthetic Peptide
DPFSFDFFEDPFDDFFGNRR

SEQ ID NO: 1870 - protein, 20 aa, Artificial Sequence
  Synthetic Peptide
DPFSFDFFEDPFDDFFGNRR

SEQ ID NO: 1871 - protein, 11 aa, Artificial Sequence
  Synthetic Peptide
SRGAGSFFSTF

SEQ ID NO: 1872 - protein, 15 aa, Artificial Sequence
  Synthetic Peptide
RGEAHLAVNDFDLAR

SEQ ID NO: 1873 - protein, 11 aa, Artificial Sequence
  Synthetic Peptide
VTVLRGCVGCR

SEQ ID NO: 1874 - protein, 14 aa, Artificial Sequence
  Synthetic Peptide
TGGFGGRGGGHAAK

SEQ ID NO: 1875 - protein, 18 aa, Artificial Sequence
  Synthetic Peptide
GQASDEKSLPRDFIPAAH

SEQ ID NO: 1876 - protein, 24 aa, Artificial Sequence
  Synthetic Peptide
GMYQSVAGGMQPPPLQRAPPPTVR

SEQ ID NO: 1877 - protein, 12 aa, Artificial Sequence
  Synthetic Peptide
GGDSTLYSFNPR

SEQ ID NO: 1878 - protein, 9 aa, Artificial Sequence
  Synthetic Peptide
RPPSGFFLF

SEQ ID NO: 1879 - protein, 34 aa, Artificial Sequence
  Synthetic Peptide
ATNSPASITGSVSDTVNGISIQEVPAAGRGHSAR

SEQ ID NO: 1880 - protein, 34 aa, Artificial Sequence; identical to SEQ ID NO: 1879
  Synthetic Peptide

SEQ ID NO: 1881 - protein, 14 aa, Artificial Sequence
  Synthetic Peptide
ISDPLTSSPGRSSR

SEQ ID NO: 1882 - protein, 36 aa, Artificial Sequence
  Synthetic Peptide
QTVNRGGGGFGGGPGPGGLQSGQTIALPAQGLIEFR

SEQ ID NO: 1883 - protein, 18 aa, Artificial Sequence
  Synthetic Peptide
GGGGGGGGGPGGFQPAPR

SEQ ID NO: 1884 - protein, 19 aa, Artificial Sequence
  Synthetic Peptide
RGGGSGGGDESEGEEVDED

SEQ ID NO: 1885 - protein, 27 aa, Artificial Sequence
  Synthetic Peptide
LFAPGALGPGSGYPGAGFPFAFPGALR

SEQ ID NO: 1886 - protein, 29 aa, Artificial Sequence
  Synthetic Peptide
GRGILILPAHTALSVSSSGSPESTPLGPR

SEQ ID NO: 1887 - protein, 37 aa, Artificial Sequence
  Synthetic Peptide
GRGILILPAHTALSVSSSGSPESTPLGPRLLFGSGSK

SEQ ID NO: 1888 - protein, 27 aa, Artificial Sequence
  Synthetic Peptide
GILILPAHTALSVSSSGSPESTPLGPR

SEQ ID NO: 1889 - protein, 11 aa, Artificial Sequence
  Synthetic Peptide
EGGGRGTNLGK

SEQ ID NO: 1890 - protein, 11 aa, Artificial Sequence
  Synthetic Peptide
RGAGGHGHARR

SEQ ID NO: 1891 - protein, 15 aa, Artificial Sequence
  Synthetic Peptide
HAASCHPMHRGGPGR

SEQ ID NO: 1892 - protein, 24 aa, Artificial Sequence
  Synthetic Peptide
YATKPMTYVVGIDSDGWVRDVTQR

SEQ ID NO: 1893 - protein, 13 aa, Artificial Sequence
  Synthetic Peptide
APAGYIIRGVFTR

SEQ ID NO: 1894 - protein, 22 aa, Artificial Sequence
  Synthetic Peptide
SSPYHSQLDVRSSTPTSYQAPK

SEQ ID NO: 1895 - protein, 12 aa, Artificial Sequence
  Synthetic Peptide
IYPYELLLVTTR

SEQ ID NO: 1896 - protein, 14 aa, Artificial Sequence
  Synthetic Peptide
HCSQVDSVRGFGGK

SEQ ID NO: 1897 - protein, 22 aa, Artificial Sequence
  Synthetic Peptide
RTFGGAPGFSLGSPLSSPVFPR

SEQ ID NO: 1898 - protein, 21 aa, Artificial Sequence
  Synthetic Peptide
TFGGAPGFSLGSPLSSPVFPR

SEQ ID NO: 1899 - protein, 15 aa, Artificial Sequence
  Synthetic Peptide
GSSSSMTSRVYQVSR

SEQ ID NO: 1900 - protein, 12 aa, Artificial Sequence
  Synthetic Peptide
TSGGAGGLGSLR

SEQ ID NO: 1901 - protein, 15 aa, Artificial Sequence
  Synthetic Peptide
TSGGAGGLGSLRSSR

SEQ ID NO: 1902 - protein, 14 aa, Artificial Sequence
  Synthetic Peptide
GLPSPYNMSAPGSR

SEQ ID NO: 1903 - protein, 26 aa, Artificial Sequence
  Synthetic Peptide
RGSFDATGNSSYSYSYSFSSSSIGGY

SEQ ID NO: 1904 - protein, 11 aa, Artificial Sequence
  Synthetic Peptide
GAGGQGQLDVR

SEQ ID NO: 1905 - protein, 14 aa, Artificial Sequence
  Synthetic Peptide
RSIQFVDWCPTGFK

SEQ ID NO: 1906 - protein, 10 aa, Artificial Sequence
  Synthetic Peptide
YVFQGPYGPR

SEQ ID NO: 1907 - protein, 21 aa, Artificial Sequence
  Synthetic Peptide
ATSSSSSSSGVGMSVGQGRGK

SEQ ID NO: 1908 - protein, 6 aa, Artificial Sequence
  Synthetic Peptide
LDIRGK

SEQ ID NO: 1909 - protein, 20 aa, Artificial Sequence
  Synthetic Peptide
TPQASTYSYETSDRCYTTEK

SEQ ID NO: 1910 - protein, 22 aa, Artificial Sequence
  Synthetic Peptide
RGVSGDREENSFSLNSSISSAR

SEQ ID NO: 1911 - protein, 9 aa, Artificial Sequence
  Synthetic Peptide
SSSMSVTGR

SEQ ID NO: 1912 - protein, 27 aa, Artificial Sequence
  Synthetic Peptide
SSSMSVTGRGGPRPVSSSIDPSLLSTK

SEQ ID NO: 1913 - protein, 20 aa, Artificial Sequence
  Synthetic Peptide
ETALDVLHSESSDRGGPSSK

SEQ ID NO: 1914 - protein, 10 aa, Artificial Sequence
  Synthetic Peptide
AGALRLPSER

SEQ ID NO: 1915 - protein, 25 aa, Artificial Sequence
  Synthetic Peptide
NVIGLQMGTNRGASQAGMTGYGMPR

SEQ ID NO: 1916 - protein, 14 aa, Artificial Sequence
  Synthetic Peptide
GASQAGMTGYGMPR

SEQ ID NO: 1917 - protein, 26 aa, Artificial Sequence
  Synthetic Peptide
TPVFVSPTPPPPPPPLPSALSTSSLR

SEQ ID NO: 1918 - protein, 34 aa, Artificial Sequence
  Synthetic Peptide
SPSVSPDRGSTPTSPYSVPQIAPLPSSTLCPICK

SEQ ID NO: 1919 - protein, 16 aa, Artificial Sequence
  Synthetic Peptide
QVEQAVQTAPYRGGPR

SEQ ID NO: 1920 - protein, 18 aa, Artificial Sequence
  Synthetic Peptide
QVEQAVQTAPYRGGPRGR

SEQ ID NO: 1921 - protein, 15 aa, Artificial Sequence
  Synthetic Peptide
FARYNLPNQVTPLAR

SEQ ID NO: 1922 - protein, 13 aa, Artificial Sequence
  Synthetic Peptide
YNLPNQVTPLARR

SEQ ID NO: 1923 - protein, 29 aa, Artificial Sequence
  Synthetic Peptide
YLGQGLQYGSFTDLRHPTDLLSHPLPLRR

SEQ ID NO: 1924 - protein, 24 aa, Artificial Sequence
  Synthetic Peptide
YGPRGDAVGFQEASLAQYSATTAR

SEQ ID NO: 1925 - protein, 11 aa, Artificial Sequence
  Synthetic Peptide
LSSHDYSSRGK

SEQ ID NO: 1926 - protein, 14 aa, Artificial Sequence
  Synthetic Peptide
AGSKPSSLSMAHGR

SEQ ID NO: 1927 - protein, 40 aa, Artificial Sequence
  Synthetic Peptide
LQPQSQPTTRGTAPAASQPAGKPQPGPTTAPGPQPAGPPR

SEQ ID NO: 1928 - protein, 26 aa, Artificial Sequence
  Synthetic Peptide
QILEMSAEEDNLEEDDTAVSGRGLAK

SEQ ID NO: 1929 - protein, 39 aa, Artificial Sequence
  Synthetic Peptide
TVSSPIPYTPSPSSSRPISPGLSYASHTVGFTPPTSLTR

SEQ ID NO: 1930 - protein, 23 aa, Artificial Sequence
  Synthetic Peptide
PISPGLSYASHTVGFTPPTSLTR

SEQ ID NO: 1931 - protein, 23 aa, Artificial Sequence
  Synthetic Peptide
AWNTEDDLPVYLARPGSAAQTPR

SEQ ID NO: 1932 - protein, 8 aa, Artificial Sequence
  Synthetic Peptide
IVAPPGGR

SEQ ID NO: 1933 - protein, 11 aa, Artificial Sequence
  Synthetic Peptide
GLVRQSVELRR

SEQ ID NO: 1934 - protein, 11 aa, Artificial Sequence
  Synthetic Peptide
CQRGGNQWNPR

SEQ ID NO: 1935 - protein, 17 aa, Artificial Sequence
  Synthetic Peptide
VAPGGRGAQLSTSSPAR

SEQ ID NO: 1936 - protein, 20 aa, Artificial Sequence
  Synthetic Peptide
PSRGPSPGPELAATPASIFR

SEQ ID NO: 1937 - protein, 35 aa, Artificial Sequence
  Synthetic Peptide
PSRGPSPGPELAATPASIFRTPLQLDPQQEQQLFR

SEQ ID NO: 1938 - protein, 14 aa, Artificial Sequence
  Synthetic Peptide
SSLAGPEPSLTWAR

SEQ ID NO: 1939 - protein, 11 aa, Artificial Sequence
  Synthetic Peptide
MDTQPDRKPSR

SEQ ID NO: 1940 - protein, 10 aa, Artificial Sequence
  Synthetic Peptide
RSYASETVVR

SEQ ID NO: 1941 - protein, 15 aa, Artificial Sequence
  Synthetic Peptide
SYASETVVRGLGPSR

SEQ ID NO: 1942 - protein, 15 aa, Artificial Sequence
  Synthetic Peptide
SYASETVVRGLGPSR

SEQ ID NO: 1943 - protein, 7 aa, Artificial Sequence
  Synthetic Peptide
QLGTMPR

SEQ ID NO: 1944 - protein, 17 aa, Artificial Sequence
  Synthetic Peptide
SSRGGQQGSFSGQTSGR

SEQ ID NO: 1945 - protein, 10 aa, Artificial Sequence
  Synthetic Peptide
SLCRGGGGSR

SEQ ID NO: 1946 - protein, 24 aa, Artificial Sequence
  Synthetic Peptide
SLCRGGGGSRNFSSGSAGLVSFQR

SEQ ID NO: 1947 - protein, 34 aa, Artificial Sequence
  Synthetic Peptide
MSGECTPNVSVSVSTSHTSMSGSSSRGGGSGGGR

SEQ ID NO: 1948 - protein, 34 aa, Artificial Sequence; identical to SEQ ID NO: 1947
  Synthetic Peptide

SEQ ID NO: 1949 - protein, 51 aa, Artificial Sequence
  Synthetic Peptide
YGGGGSYGGGSGGGSYGGSSGGGGSGGSYGGGSGGGSYGGGSGGGSSGSHR

SEQ ID NO: 1950 - protein, 33 aa, Artificial Sequence
  Synthetic Peptide
GGSGGGGGSSGGSYGGSSGGGRGGSSSGGGGVK

SEQ ID NO: 1951 - protein, 11 aa, Artificial Sequence
  Synthetic Peptide
FVSTSYSRGTK

SEQ ID NO: 1952 - protein, 24 aa, Artificial Sequence
  Synthetic Peptide
VSSTRGSLGGGYSSGGFSGGSFSR

SEQ ID NO: 1953 - protein, 17 aa, Artificial Sequence
  Synthetic Peptide
QTSAMSSFGGTGGGSVR

SEQ ID NO: 1954 - protein, 8 aa, Artificial Sequence
  Synthetic Peptide
IGSGGVFR

SEQ ID NO: 1955 - protein, 27 aa, Artificial Sequence
  Synthetic Peptide
IGSGGVFRAPSIHGGSGGRGVSVSSTR

SEQ ID NO: 1956 - protein, 27 aa, Artificial Sequence
  Synthetic Peptide
IGSGGVFRAPSIHGGSGGRGVSVSSTR

SEQ ID NO: 1957 - protein, 19 aa, Artificial Sequence
  Synthetic Peptide
APSIHGGSGGRGVSVSSTR

SEQ ID NO: 1958 - protein, 19 aa, Artificial Sequence
  Synthetic Peptide
APSIHGGSGGRGVSVSSTR

SEQ ID NO: 1959 - protein, 21 aa, Artificial Sequence
  Synthetic Peptide
GVSVSSTRFVTSSSGSYGGVR

SEQ ID NO: 1960 - protein, 33 aa, Artificial Sequence
  Synthetic Peptide
FVTSSSGSYGGVRGGSFSGTLAVSDGLLSGNEK

SEQ ID NO: 1961 - protein, 9 aa, Artificial Sequence
  Synthetic Peptide
AVVSGGSRR

SEQ ID NO: 1962 - protein, 25 aa, Artificial Sequence
  Synthetic Peptide
HGGGRGGSGGGGFGSQSLVGLGGYK

SEQ ID NO: 1963 - protein, 21 aa, Artificial Sequence
  Synthetic Peptide
GSYGGRGGGGGGGSTYGSGGR

SEQ ID NO: 1964 - protein, 32 aa, Artificial Sequence
  Synthetic Peptide
GSGSGSGGGGYSSGGGSRGGSGGGYGSGGGSR

SEQ ID NO: 1965 - protein, 25 aa, Artificial Sequence
  Synthetic Peptide
GGSGGGGVSSGGGSRGGSSSGGGSR

SEQ ID NO: 1966 - protein, 25 aa, Artificial Sequence
  Synthetic Peptide
GGSGGGGVSSGGGSRGGSSSGGGSR

SEQ ID NO: 1967 - protein, 17 aa, Artificial Sequence
  Synthetic Peptide
GASRGFSSGSAIAGGVK

SEQ ID NO: 1968 - protein, 49 aa, Artificial Sequence
  Synthetic Peptide
LSGEGVGPVNISVVTNSVSSGYGGGSSIGVGSGFGGGLGSGFAGGLGPR

SEQ ID NO: 1969 - protein, 43 aa, Artificial Sequence
  Synthetic Peptide
FTRGGGGLGLGSGLSVGGSGFSAGSSQGGMSFGSGGGSGSSVK

SEQ ID NO: 1970 - protein, 19 aa, Artificial Sequence
  Synthetic Peptide
SRGSGGSSAMCGGAGFGSR

SEQ ID NO: 1971 - protein, 34 aa, Artificial Sequence
  Synthetic Peptide
GPGGGFGGGIGGGIGGGRGFGGGGFGGGYGGGGR

SEQ ID NO: 1972 - protein, 28 aa, Artificial Sequence
  Synthetic Peptide
GGGGGGGGTGSRGGGGGGGGSSYVSSSR

SEQ ID NO: 1973 - protein, 28 aa, Artificial Sequence
  Synthetic Peptide
GGGGGGGGTGSRGGGGGGGGSSYVSSSR

SEQ ID NO: 1974 - protein, 22 aa, Artificial Sequence
  Synthetic Peptide
YGSGGGSSRTQILQTSTHSSRR

SEQ ID NO: 1975 - protein, 22 aa, Artificial Sequence
  Synthetic Peptide
YGSGGGSSRTQILQTSTHSSRR

SEQ ID NO: 1976 - protein, 22 aa, Artificial Sequence
  Synthetic Peptide
YGSGGGSSRTQILQTSTHSSRR

SEQ ID NO: 1977 - protein, 43 aa, Artificial Sequence
  Synthetic Peptide
SASGFCQSRGPGGGFGGGIGGGIGGGRGFGGGGFGGGYGGGGR

SEQ ID NO: 1978 - protein, 34 aa, Artificial Sequence; identical to SEQ ID NO: 1971
  Synthetic Peptide

SEQ ID NO: 1979 - protein, 10 aa, Artificial Sequence
  Synthetic Peptide
SACSAFSGAR

SEQ ID NO: 1980 - protein, 22 aa, Artificial Sequence
  Synthetic Peptide
GSGGQVTIPGRGSGGQVTVPRG

SEQ ID NO: 1981 - protein, 33 aa, Artificial Sequence
  Synthetic Peptide
GSGGQVTIPGRGSGGQVTVPGRGSGGQVTIPGR

SEQ ID NO: 1982 - protein, 22 aa, Artificial Sequence
  Synthetic Peptide
GSGGQVTIPGRGSGGQVTVPGR

SEQ ID NO: 1983 - protein, 22 aa, Artificial Sequence
  Synthetic Peptide
GSGGQVTIPGRGSGGQVTIPGR

SEQ ID NO: 1984 - protein, 33 aa, Artificial Sequence; identical to SEQ ID NO: 1530
  Synthetic Peptide

SEQ ID NO: 1985 - protein, 13 aa, Artificial Sequence
  Synthetic Peptide
EMAQMYQMSLRGK

SEQ ID NO: 1986 - protein, 36 aa, Artificial Sequence
  Synthetic Peptide
SRPQASAYSPAAAASPAPSAHTSYSEGPAAPAPKPR

SEQ ID NO: 1987 - protein, 25 aa, Artificial Sequence
  Synthetic Peptide
AAYSGGPSESASRPPWVTDDSFSQK

SEQ ID NO: 1988 - protein, 22 aa, Artificial Sequence
  Synthetic Peptide
QTLPRGAPAYNPTGPQVTPLAR

SEQ ID NO: 1989 - protein, 22 aa, Artificial Sequence
  Synthetic Peptide
QTLPRGAPAYNPTGPQVTPLAR

SEQ ID NO: 1990 - protein, 17 aa, Artificial Sequence
  Synthetic Peptide
GAPAYNPTGPQVTPLAR

SEQ ID NO: 1991 - protein, 22 aa, Artificial Sequence
  Synthetic Peptide
GAPAYNPTGPQVTPLARGTFQR

SEQ ID NO: 1992 - protein, 10 aa, Artificial Sequence
  Synthetic Peptide
RGQSSAPPTR

SEQ ID NO: 1993 - protein, 10 aa, Artificial Sequence
  Synthetic Peptide
LDFKDRVQSK

SEQ ID NO: 1994 - protein, 8 aa, Artificial Sequence
  Synthetic Peptide
SPLPSHAR

SEQ ID NO: 1995 - protein, 17 aa, Artificial Sequence
  Synthetic Peptide
FSWGAEGQKPGFGYGGR

SEQ ID NO: 1996 - protein, 16 aa, Artificial Sequence
  Synthetic Peptide
DTGILDSIGRFFSGDR

SEQ ID NO: 1997 - protein, 20 aa, Artificial Sequence
  Synthetic Peptide
DTGILDSIGRFFSGDRGAPK

SEQ ID NO: 1998 - protein, 10 aa, Artificial Sequence
  Synthetic Peptide
FFSGDRGAPK

SEQ ID NO: 1999 - protein, 20 aa, Artificial Sequence
  Synthetic Peptide
QELLEKAYREATSQGNSSHR

SEQ ID NO: 2000 - protein, 15 aa, Artificial Sequence
  Synthetic Peptide
SIIAGYNAILCCAVR

SEQ ID NO: 2001 - protein, 22 aa, Artificial Sequence
  Synthetic Peptide
QGVLTLEIRKPCPYDGGVYVCR

SEQ ID NO: 2002 - protein, 14 aa, Artificial Sequence
  Synthetic Peptide
SAVYTHGSTAYSSR

SEQ ID NO: 2003 - protein, 28 aa, Artificial Sequence
  Synthetic Peptide
HFIQPQNPCGSRLQPPGPEVSGFPSQTK

SEQ ID NO: 2004 - protein, 9 aa, Artificial Sequence
  Synthetic Peptide
QSSIVIQPR

SEQ ID NO: 2005 - protein, 16 aa, Artificial Sequence
  Synthetic Peptide
DIMIEELSHFSNRGAR

SEQ ID NO: 2006 - protein, 16 aa, Artificial Sequence
  Synthetic Peptide
DIMIEELSHFSNRGAR

SEQ ID NO: 2007 - protein, 16 aa, Artificial Sequence
  Synthetic Peptide
NRGGPILGNVTISAER

SEQ ID NO: 2008 - protein, 13 aa, Artificial Sequence
  Synthetic Peptide
YVETPRVHISSVR

SEQ ID NO: 2009 - protein, 13 aa, Artificial Sequence
  Synthetic Peptide
YVETPRVHISSVR

SEQ ID NO: 2010 - protein, 18 aa, Artificial Sequence
  Synthetic Peptide
SAYSSYSAPVSSSLSVRR

SEQ ID NO: 2011 - protein, 18 aa, Artificial Sequence
  Synthetic Peptide
SAYSSYSAPVSSSLSVRR

SEQ ID NO: 2012 - protein, 15 aa, Artificial Sequence
  Synthetic Peptide
SSFSRVSGSPSSGFR

SEQ ID NO: 2013 - protein, 10 aa, Artificial Sequence
  Synthetic Peptide
VSGSPSSGFR

SEQ ID NO: 2014 - protein, 17 aa, Artificial Sequence
  Synthetic Peptide
SQSWSRGSPSTVSSSYK

SEQ ID NO: 2015 - protein, 28 aa, Artificial Sequence
  Synthetic Peptide
QVVSASYNSPIGLYSTSNIQDALHGQLR

SEQ ID NO: 2016 - protein, 16 aa, Artificial Sequence
  Synthetic Peptide
SKYPQHALALRGQQDR

SEQ ID NO: 2017 - protein, 16 aa, Artificial Sequence
  Synthetic Peptide
SKYPQHALALRGQQDR

SEQ ID NO: 2018 - protein, 24 aa, Artificial Sequence
  Synthetic Peptide
SRLSYAGGRPPSYAGSPVHHAAER

SEQ ID NO: 2019 - protein, 24 aa, Artificial Sequence
  Synthetic Peptide
SRLSYAGGRPPSYAGSPVHHAAER

SEQ ID NO: 2020 - protein, 29 aa, Artificial Sequence
  Synthetic Peptide
LADVSAPSGGPPPPHSPYSGPPSRGSPVR

SEQ ID NO: 2021 - protein, 29 aa, Artificial Sequence
  Synthetic Peptide
LADVSAPSGGPPPPHSPYSGPPSRGSPVR

SEQ ID NO: 2022 - protein, 17 aa, Artificial Sequence
  Synthetic Peptide
GLQNSASDLRGQLQQLR

SEQ ID NO: 2023 - protein, 22 aa, Artificial Sequence
  Synthetic Peptide
PAPAETLRPFSPPQGPPPPPAR

SEQ ID NO: 2024 - protein, 22 aa, Artificial Sequence
  Synthetic Peptide
PAPAETLRPFSPPQGPPPPPAR

SEQ ID NO: 2025 - protein, 12 aa, Artificial Sequence
  Synthetic Peptide
NFRGAAFSPIPR

SEQ ID NO: 2026 - protein, 24 aa, Artificial Sequence
  Synthetic Peptide
RPLGNFTPPPTYAETLSTAPVASR

SEQ ID NO: 2027 - protein, 9 aa, Artificial Sequence
  Synthetic Peptide
TPSRTVSPR

SEQ ID NO: 2028 - protein, 18 aa, Artificial Sequence
  Synthetic Peptide
AASPAKPSSLDLVPNLPR

SEQ ID NO: 2029 - protein, 32 aa, Artificial Sequence
  Synthetic Peptide
AGLGTAESQNSGLGGQLSEVSGRGVQLFEQQR

SEQ ID NO: 2030 - protein, 42 aa, Artificial Sequence
  Synthetic Peptide
AQSAPPEAAVLPLSPLSVPAVSPTPFFPDGGAPIPAPSIFNR

SEQ ID NO: 2031 - protein, 13 aa, Artificial Sequence
  Synthetic Peptide
SARPFTPGLQGQR

SEQ ID NO: 2032 - protein, 13 aa, Artificial Sequence
  Synthetic Peptide
SARPFTPGLQGQR

SEQ ID NO: 2033 - protein, 10 aa, Artificial Sequence
  Synthetic Peptide
PFTPGLQGQR

SEQ ID NO: 2034 - protein, 11 aa, Artificial Sequence
  Synthetic Peptide
LQGRGGELFAK

SEQ ID NO: 2035 - protein, 18 aa, Artificial Sequence
  Synthetic Peptide
YVVEATSGSSLNPGLRPR

SEQ ID NO: 2036 - protein, 26 aa, Artificial Sequence
  Synthetic Peptide
YSPNIRAPPPIAYNPLLSPFFPQAAR

SEQ ID NO: 2037 - protein, 26 aa, Artificial Sequence
  Synthetic Peptide
YSPNIRAPPPIAYNPLLSPFFPQAAR

SEQ ID NO: 2038 - protein, 22 aa, Artificial Sequence
  Synthetic Peptide
RFSTPAPQPTAEPLAPTVLVPR

SEQ ID NO: 2039 - protein, 22 aa, Artificial Sequence
  Synthetic Peptide
RFSTPAPQPTAEPLAPTVLVPR

SEQ ID NO: 2040 - protein, 21 aa, Artificial Sequence
  Synthetic Peptide
FSTPAPQPTAEPLAPTVLVPR

SEQ ID NO: 2041 - protein, 29 aa, Artificial Sequence
  Synthetic Peptide
AATTLDEPIWRAELASTPVPNPDHQESLR

SEQ ID NO: 2042 - protein, 17 aa, Artificial Sequence
  Synthetic Peptide
SFAAAPSSCGFQVARPR

SEQ ID NO: 2043 - protein, 10 aa, Artificial Sequence
  Synthetic Peptide
SSSSGEISRK

SEQ ID NO: 2044 - protein, 31 aa, Artificial Sequence; identical to SEQ ID NO: 1535
  Synthetic Peptide

SEQ ID NO: 2045 - protein, 30 aa, Artificial Sequence
  Synthetic Peptide
RPPPPARGGGSGGGGGGSSSSSSSSQQQLR

SEQ ID NO: 2046 - protein, 31 aa, Artificial Sequence; identical to SEQ ID NO: 1535
  Synthetic Peptide

SEQ ID NO: 2047 - protein, 12 aa, Artificial Sequence
  Synthetic Peptide
GIGRGIALQLCK

SEQ ID NO: 2048 - protein, 20 aa, Artificial Sequence
  Synthetic Peptide
VPPQPSPGRGGTSTTCSAPR

SEQ ID NO: 2049 - protein, 19 aa, Artificial Sequence
  Synthetic Peptide
RPFPTPSADPRLPLVPCPR

SEQ ID NO: 2050 - protein, 22 aa, Artificial Sequence
  Synthetic Peptide
RGGPTSVPNAPLAVAVSSRPPR

SEQ ID NO: 2051 - protein, 17 aa, Artificial Sequence
  Synthetic Peptide
RWLVLCNPGLAEVIAER

SEQ ID NO: 2052 - protein, 10 aa, Artificial Sequence
  Synthetic Peptide
GSLLHSYTPR

SEQ ID NO: 2053 - protein, 28 aa, Artificial Sequence
  Synthetic Peptide
DLEVLAEIASSPAGQTDDPGAPDGPDLR

SEQ ID NO: 2054 - protein, 17 aa, Artificial Sequence
  Synthetic Peptide
ATEGSGSVRGGGGGNAR

SEQ ID NO: 2055 - protein, 12 aa, Artificial Sequence
  Synthetic Peptide
SGLGASPLQSAR

SEQ ID NO: 2056 - protein, 14 aa, Artificial Sequence
  Synthetic Peptide
GPLRPFVPEQELLR

SEQ ID NO: 2057 - protein, 13 aa, Artificial Sequence
  Synthetic Peptide
SIRGFCLPPHCSR

SEQ ID NO: 2058 - protein, 19 aa, Artificial Sequence
  Synthetic Peptide
GAGRGLEKPPHLAALVLAR

SEQ ID NO: 2059 - protein, 19 aa, Artificial Sequence
  Synthetic Peptide
GAGRGLEKPPHLAALVLAR

SEQ ID NO: 2060 - protein, 10 aa, Artificial Sequence
  Synthetic Peptide
NLPIPPFQVR

SEQ ID NO: 2061 - protein, 20 aa, Artificial Sequence
  Synthetic Peptide
RSIEDRVQEEARCLVEELRK

SEQ ID NO: 2062 - protein, 14 aa, Artificial Sequence
  Synthetic Peptide
RGFGFGGFAISAGK

SEQ ID NO: 2063 - protein, 9 aa, Artificial Sequence
  Synthetic Peptide
YTENRGGSR

SEQ ID NO: 2064 - protein, 12 aa, Artificial Sequence
  Synthetic Peptide
LRGGLGWESSLR

SEQ ID NO: 2065 - protein, 6 aa, Artificial Sequence
  Synthetic Peptide
QRPMPR

SEQ ID NO: 2066 - protein, 13 aa, Artificial Sequence
  Synthetic Peptide
ILAPPGGRSSGIW

SEQ ID NO: 2067 - protein, 10 aa, Artificial Sequence
  Synthetic Peptide
IAMTNGCINR

SEQ ID NO: 2068 - protein, 10 aa, Artificial Sequence
  Synthetic Peptide
EDLPVTRKRK

SEQ ID NO: 2069 - protein, 14 aa, Artificial Sequence
  Synthetic Peptide
PAGGRGGWGWGGGK

SEQ ID NO: 2070 - protein, 21 aa, Artificial Sequence
  Synthetic Peptide
LTGMAFRVPTPNVSVVDLTCR

SEQ ID NO: 2071 - protein, 11 aa, Artificial Sequence
  Synthetic Peptide
GLEPLKNNRFR

SEQ ID NO: 2072 - protein, 21 aa, Artificial Sequence
  Synthetic Peptide
GAFALVFKSIHYPGEAVATRR

SEQ ID NO: 2073 - protein, 16 aa, Artificial Sequence
  Synthetic Peptide
DTTVTGLGRGQQQVFK

SEQ ID NO: 2074 - protein, 21 aa, Artificial Sequence
  Synthetic Peptide
SFYDEDALGPVLTTFDSALDR

SEQ ID NO: 2075 - protein, 38 aa, Artificial Sequence
  Synthetic Peptide
QTGVAQVRPTGILNGPTVDSSLPTNSVSGQQPQLPLTR

SEQ ID NO: 2076 - protein, 10 aa, Artificial Sequence
  Synthetic Peptide
GEFITTVQQR

SEQ ID NO: 2077 - protein, 12 aa, Artificial Sequence
  Synthetic Peptide
HLLEQTNPRGGK

SEQ ID NO: 2078 - protein, 23 aa, Artificial Sequence
  Synthetic Peptide
VWRGGEGASAYQVQEAPASQPVR

SEQ ID NO: 2079 - protein, 8 aa, Artificial Sequence
  Synthetic Peptide
LCRAGAHR

SEQ ID NO: 2080 - protein, 10 aa, Artificial Sequence
  Synthetic Peptide
FELRPGSGGR

SEQ ID NO: 2081 - protein, 15 aa, Artificial Sequence
  Synthetic Peptide
RSHSPPTDGTSKRLK

SEQ ID NO: 2082 - protein, 22 aa, Artificial Sequence
  Synthetic Peptide
DFMIQGGDPTGTGRGGASIYGK

SEQ ID NO: 2083 - protein, 22 aa, Artificial Sequence
  Synthetic Peptide
GFMVQTGDPTGTGRGGSSIWAK

SEQ ID NO: 2084 - protein, 12 aa, Artificial Sequence
  Synthetic Peptide
EGDRMMGEQVAR

SEQ ID NO: 2085 - protein, 18 aa, Artificial Sequence
  Synthetic Peptide
LKQEYFVVAATLQDVIRR

SEQ ID NO: 2086 - protein, 16 aa, Artificial Sequence
  Synthetic Peptide
GGHSLASNIRPANLYR

SEQ ID NO: 2087 - protein, 31 aa, Artificial Sequence
  Synthetic Peptide
LGTPFSQDSSYSSRQPTPSYLFSQDPTATFK

SEQ ID NO: 2088 - protein, 13 aa, Artificial Sequence
  Synthetic Peptide
STKSRTHSKPVRK

SEQ ID NO: 2089 - protein, 15 aa, Artificial Sequence
  Synthetic Peptide
LGAVRGGLMSSPPGR

SEQ ID NO: 2090 - protein, 11 aa, Artificial Sequence
  Synthetic Peptide
VDAQFGGVDQR

SEQ ID NO: 2091 - protein, 17 aa, Artificial Sequence
  Synthetic Peptide
HRGGCPGPGGAGAPPPR

SEQ ID NO: 2092 - protein, 23 aa, Artificial Sequence
  Synthetic Peptide
MVRAGAVGTHLPTSSLDIFGDLR

SEQ ID NO: 2093 - protein, 23 aa, Artificial Sequence
  Synthetic Peptide
SLPAGDALYLSFNPPQPSRGHDR

SEQ ID NO: 2094 - protein, 23 aa, Artificial Sequence
  Synthetic Peptide
SLPAGDALYLSFNPPQPSRGHDR

SEQ ID NO: 2095 - protein, 13 aa, Artificial Sequence
  Synthetic Peptide
RAPAVPPARPGSR

SEQ ID NO: 2096 - protein, 42 aa, Artificial Sequence
  Synthetic Peptide
GPAPGPPPAGSALGGAPPVPSRPGASPDPFGPPPQVPSRPNR

SEQ ID NO: 2097 - protein, 13 aa, Artificial Sequence
  Synthetic Peptide
FKLPGQPPASMGR

SEQ ID NO: 2098 - protein, 27 aa, Artificial Sequence
  Synthetic Peptide
LRVEHLPLLTIEPPSDSSVELSDRSDR

SEQ ID NO: 2099 - protein, 27 aa, Artificial Sequence
  Synthetic Peptide
LRVEHLPLLTIEPPSDSSVELSDRSDR

SEQ ID NO: 2100 - protein, 24 aa, Artificial Sequence
  Synthetic Peptide
LPGGDLSLPGEAPPATVQAATLAR

SEQ ID NO: 2101 - protein, 20 aa, Artificial Sequence
  Synthetic Peptide
EQQAADAKKQAEESMVASMR

SEQ ID NO: 2102 - protein, 8 aa, Artificial Sequence
  Synthetic Peptide
DFAFYNPR

SEQ ID NO: 2103 - protein, 24 aa, Artificial Sequence
  Synthetic Peptide
QSSMTVVSQYDNLEDYHSLPQHQR

SEQ ID NO: 2104 - protein, 17 aa, Artificial Sequence
  Synthetic Peptide
LLYRPAPPSYGRGGEVR

SEQ ID NO: 2105 - protein, 20 aa, Artificial Sequence
  Synthetic Peptide
QSDPILPWGASWAGRGQTLR

SEQ ID NO: 2106 - protein, 11 aa, Artificial Sequence
  Synthetic Peptide
NPPNADRPLPR

SEQ ID NO: 2107 - protein, 15 aa, Artificial Sequence
  Synthetic Peptide
HGPAAAAAASRGAPR

SEQ ID NO: 2108 - protein, 22 aa, Artificial Sequence
  Synthetic Peptide
YSRGGVRPVTHQLSSLALVASK

SEQ ID NO: 2109 - protein, 22 aa, Artificial Sequence
  Synthetic Peptide
YSRGGVRPVTHQLSSLALVASK

SEQ ID NO: 2110 - protein, 15 aa, Artificial Sequence
  Synthetic Peptide
LSAETWDLLRLPLDR

SEQ ID NO: 2111 - protein, 17 aa, Artificial Sequence
  Synthetic Peptide
SAAGFPLSGTATWTLGR

SEQ ID NO: 2112 - protein, 22 aa, Artificial Sequence
  Synthetic Peptide
HASAAGFPLSGTATWTLGRGYR

SEQ ID NO: 2113 - protein, 14 aa, Artificial Sequence
  Synthetic Peptide
RGAGGHPQFAPHGR

SEQ ID NO: 2114 - protein, 9 aa, Artificial Sequence
  Synthetic Peptide
GQLSRGASR

SEQ ID NO: 2115 - protein, 11 aa, Artificial Sequence
  Synthetic Peptide
ERLARLAQARR

SEQ ID NO: 2116 - protein, 10 aa, Artificial Sequence
  Synthetic Peptide
GYDRGGSMGR

SEQ ID NO: 2117 - protein, 21 aa, Artificial Sequence
  Synthetic Peptide
GGSEPATSTLPAAAAATNGPR

SEQ ID NO: 2118 - protein, 23 aa, Artificial Sequence
  Synthetic Peptide
FVSCLLEQPEVSVTGAGRGHAGR

SEQ ID NO: 2119 - protein, 24 aa, Artificial Sequence
  Synthetic Peptide
ISQLFRGSGAGGAGGPGTPGGAQR

SEQ ID NO: 2120 - protein, 13 aa, Artificial Sequence
  Synthetic Peptide
LGRGVALAQTSQR

SEQ ID NO: 2121 - protein, 14 aa, Artificial Sequence
  Synthetic Peptide
FLRSDLYLDLINQK

SEQ ID NO: 2122 - protein, 14 aa, Artificial Sequence
  Synthetic Peptide
RGSTPWGPAPPLHR

SEQ ID NO: 2123 - protein, 8 aa, Artificial Sequence
  Synthetic Peptide
RQAGTRRR

SEQ ID NO: 2124 - protein, 24 aa, Artificial Sequence
  Synthetic Peptide
MHPASVTTTSQDPCAPSGSCRGGR

SEQ ID NO: 2125 - protein, 17 aa, Artificial Sequence
  Synthetic Peptide
ASIHRGSIPAMSYAPFR

SEQ ID NO: 2126 - protein, 12 aa, Artificial Sequence
  Synthetic Peptide
DLFYVSRPPLAR

SEQ ID NO: 2127 - protein, 12 aa, Artificial Sequence
  Synthetic Peptide
PGTTVASGVTAR

SEQ ID NO: 2128 - protein, 16 aa, Artificial Sequence
  Synthetic Peptide
SLTSSLENIFSRGANR

SEQ ID NO: 2129 - protein, 16 aa, Artificial Sequence
  Synthetic Peptide
SLTSSLENIFSRGANR

SEQ ID NO: 2130 - protein, 12 aa, Artificial Sequence
  Synthetic Peptide
TNARGAPLNIHK

SEQ ID NO: 2131 - protein, 14 aa, Artificial Sequence
  Synthetic Peptide
ASLLITTRPVALEK

SEQ ID NO: 2132 - protein, 17 aa, Artificial Sequence
  Synthetic Peptide
PLLSQHSRGGCSSESSR

SEQ ID NO: 2133 - protein, 20 aa, Artificial Sequence
  Synthetic Peptide
NIDRVVFVGNFLRINMVSMK

SEQ ID NO: 2134 - protein, 12 aa, Artificial Sequence
  Synthetic Peptide
SVGELRLLFEAR

SEQ ID NO: 2135 - protein, 12 aa, Artificial Sequence
  Synthetic Peptide
SVGELRLLFEAR

SEQ ID NO: 2136 - protein, 14 aa, Artificial Sequence
  Synthetic Peptide
CAAVAAAAAAGEPR

SEQ ID NO: 2137 - protein, 11 aa, Artificial Sequence
  Synthetic Peptide
RGGQVPNGLPR

SEQ ID NO: 2138 - protein, 12 aa, Artificial Sequence
  Synthetic Peptide
PSGSETPQPSGR

SEQ ID NO: 2139 - protein, 37 aa, Artificial Sequence
  Synthetic Peptide
AALSPGSVFSPGRGASFLFPPAESLSLEEPGSPGGWR

SEQ ID NO: 2140 - protein, 10 aa, Artificial Sequence
  Synthetic Peptide
MGLEALRGGR

SEQ ID NO: 2141 - protein, 26 aa, Artificial Sequence
  Synthetic Peptide
GRGALLAVKPLGPTAAFSASQIPSER

SEQ ID NO: 2142 - protein, 18 aa, Artificial Sequence
  Synthetic Peptide
RGGNNNGSEPSDVIIPLR

SEQ ID NO: 2143 - protein, 20 aa, Artificial Sequence
  Synthetic Peptide
GSFGRGGSLGLGGGGGMGPR

SEQ ID NO: 2144 - protein, 11 aa, Artificial Sequence
  Synthetic Peptide
QISDYFPRFPR

SEQ ID NO: 2145 - protein, 11 aa, Artificial Sequence
  Synthetic Peptide
RMMSPGGSCLK

SEQ ID NO: 2146 - protein, 39 aa, Artificial Sequence
  Synthetic Peptide
LNQATVASNRPGLFYGQCSEICGSNHSFMPIVLEMVPLK

SEQ ID NO: 2147 - protein, 17 aa, Artificial Sequence
  Synthetic Peptide
ELEGVLGDCRFVSATFR

SEQ ID NO: 2148 - protein, 10 aa, Artificial Sequence
  Synthetic Peptide
VVVSGGRGLK

SEQ ID NO: 2149 - protein, 31 aa, Artificial Sequence
  Synthetic Peptide
GTFLVTQAAAQALVSSGGRGSIINISSIIGK

SEQ ID NO: 2150 - protein, 17 aa, Artificial Sequence
  Synthetic Peptide
RPVGSLAAVCSRSMASK

SEQ ID NO: 2151 - protein, 12 aa, Artificial Sequence
  Synthetic Peptide
GPGTSRGGSPTR

SEQ ID NO: 2152 - protein, 11 aa, Artificial Sequence
  Synthetic Peptide
RGGTWFAGFGR

SEQ ID NO: 2153 - protein, 10 aa, Artificial Sequence
  Synthetic Peptide
AQVLAGGRGK

SEQ ID NO: 2154 - protein, 29 aa, Artificial Sequence
  Synthetic Peptide
NSRVARQPQGEGNFEVFSQLLAGMDVDLR

SEQ ID NO: 2155 - protein, 18 aa, Artificial Sequence
  Synthetic Peptide
SRGGGSTQPEPQHLRPQK

SEQ ID NO: 2156 - protein, 15 aa, Artificial Sequence
  Synthetic Peptide
LQGLQGAGGRGGGLR

SEQ ID NO: 2157 - protein, 20 aa, Artificial Sequence
  Synthetic Peptide
GGGSFVQNNQPVGLRGGGGK

SEQ ID NO: 2158 - protein, 34 aa, Artificial Sequence
  Synthetic Peptide
SGGRGSGGPESTVSDPPSFFTTPTSDGVFELDPT

SEQ ID NO: 2159 - protein, 10 aa, Artificial Sequence
  Synthetic Peptide
NSGPASSEPR

SEQ ID NO: 2160 - protein, 19 aa, Artificial Sequence
  Synthetic Peptide
NSGPASSEPRLTLAPVGPR

SEQ ID NO: 2161 - protein, 9 aa, Artificial Sequence
  Synthetic Peptide
LTLAPVGPR

SEQ ID NO: 2162 - protein, 20 aa, Artificial Sequence
  Synthetic Peptide
LVLSSPRPVLAPLSIAGEQK

SEQ ID NO: 2163 - protein, 20 aa, Artificial Sequence
  Synthetic Peptide
AASLRGGVGAPGSPSTPPTR

SEQ ID NO: 2164 - protein, 18 aa, Artificial Sequence
  Synthetic Peptide
LPSRPPLPGSGGSQSGAK

SEQ ID NO: 2165 - protein, 19 aa, Artificial Sequence
  Synthetic Peptide
GGDPFWDGPGDPMRGGPMR

SEQ ID NO: 2166 - protein, 15 aa, Artificial Sequence
  Synthetic Peptide
GGPMRGGPGPAPGPY

SEQ ID NO: 2167 - protein, 38 aa, Artificial Sequence
  Synthetic Peptide
SGGGPPNGRGGPGGGGMVGGGGHRPHEGPGGSMGSGHR

SEQ ID NO: 2168 - protein, 38 aa, Artificial Sequence; identical to SEQ ID NO: 2167
  Synthetic Peptide

SEQ ID NO: 2169 - protein, 21 aa, Artificial Sequence
  Synthetic Peptide
LESGGTNPTSSDSYSDRASAR

SEQ ID NO: 2170 - protein, 21 aa, Artificial Sequence
  Synthetic Peptide
LESGGTNPTSSDSYSDRASAR

SEQ ID NO: 2171 - protein, 24 aa, Artificial Sequence
  Synthetic Peptide
VFFQSPRGGTGGSPGSSSSSGSSR

SEQ ID NO: 2172 - protein, 22 aa, Artificial Sequence
  Synthetic Peptide
IQFTVPLLEPHLDPEAAEQIRR

SEQ ID NO: 2173 - protein, 16 aa, Artificial Sequence
  Synthetic Peptide
LLGGCGVASAGRGAGR

SEQ ID NO: 2174 - protein, 21 aa, Artificial Sequence
  Synthetic Peptide
HSCGSPSEGRGYPSPGAHSPR

SEQ ID NO: 2175 - protein, 17 aa, Artificial Sequence
  Synthetic Peptide
CWIFSCLNVMRLPFMKK

SEQ ID NO: 2176 - protein, 20 aa, Artificial Sequence
  Synthetic Peptide
TLDSDSEPDAVPYQEGPRPL

SEQ ID NO: 2177 - protein, 11 aa, Artificial Sequence
  Synthetic Peptide
MQMAMNGRARK

SEQ ID NO: 2178 - protein, 15 aa, Artificial Sequence
  Synthetic Peptide
SNAECGRGGPGPAQR

SEQ ID NO: 2179 - protein, 29 aa, Artificial Sequence
  Synthetic Peptide
DPLSPFAVGGDDLDPFGCQRGGMIVDPLR

SEQ ID NO: 2180 - protein, 23 aa, Artificial Sequence
  Synthetic Peptide
VLIDPSSGLPNRLPPGAVPPGAR

SEQ ID NO: 2181 - protein, 21 aa, Artificial Sequence
  Synthetic Peptide
TLSTLSHLSSEGAAPDRGGLR

SEQ ID NO: 2182 - protein, 20 aa, Artificial Sequence
  Synthetic Peptide
IVAERPGTNSTGPGPMAPPR

SEQ ID NO: 2183 - protein, 8 aa, Artificial Sequence
  Synthetic Peptide
HQQLQQMR

SEQ ID NO: 2184 - protein, 21 aa, Artificial Sequence
  Synthetic Peptide
KPSAAAPAAYPTGRGGDTAVR

SEQ ID NO: 2185 - protein, 19 aa, Artificial Sequence
  Synthetic Peptide
RGGVSAEVYTEEDAVSYVR

SEQ ID NO: 2186 - protein, 20 aa, Artificial Sequence
  Synthetic Peptide
AGQTQPNPGILPIQPALTPR

SEQ ID NO: 2187 - protein, 14 aa, Artificial Sequence
  Synthetic Peptide
GRGSLASGALDPTK

SEQ ID NO: 2188 - protein, 25 aa, Artificial Sequence
  Synthetic Peptide
SPVFSFSPEPGAGDEARGGGSPTSK

SEQ ID NO: 2189 - protein, 10 aa, Artificial Sequence
  Synthetic Peptide
TQTLPSRGPR

SEQ ID NO: 2190 - protein, 24 aa, Artificial Sequence
  Synthetic Peptide
TQTLPSRGPRGGGAGEQPPPPSAR

SEQ ID NO: 2191 - protein, 24 aa, Artificial Sequence
  Synthetic Peptide
TQTLPSRGPRGGGAGEQPPPPSAR

SEQ ID NO: 2192 - protein, 17 aa, Artificial Sequence
  Synthetic Peptide
GPRGGGAGEQPPPPSAR

SEQ ID NO: 2193 - protein, 17 aa, Artificial Sequence
  Synthetic Peptide
GPRGGGAGEQPPPPSAR

SEQ ID NO: 2194 - protein, 12 aa, Artificial Sequence
  Synthetic Peptide
STPLPGPPGSPR

SEQ ID NO: 2195 - protein, 15 aa, Artificial Sequence
  Synthetic Peptide
SSGGTPLHSPLHTPR

SEQ ID NO: 2196 - protein, 40 aa, Artificial Sequence
  Synthetic Peptide
SSGGTPLHSPLHTPRASPTGTPGTTPPPSPGGGVGGAAWR

SEQ ID NO: 2197 - protein, 25 aa, Artificial Sequence
  Synthetic Peptide
ASPTGTPGTTPPPSPGGGVGGAAWR

SEQ ID NO: 2198 - protein, 20 aa, Artificial Sequence
  Synthetic Peptide
SRSISGASSGLSTSPLSSPR

SEQ ID NO: 2199 - protein, 20 aa, Artificial Sequence
  Synthetic Peptide
REPYGKPVDVWGCGVILFIL

SEQ ID NO: 2200 - protein, 17 aa, Artificial Sequence
  Synthetic Peptide
LHRGAPVNVSSSDLTGR

SEQ ID NO: 2201 - protein, 17 aa, Artificial Sequence
  Synthetic Peptide
LHRGAPANVSSSDLTGR

SEQ ID NO: 2202 - protein, 22 aa, Artificial Sequence
  Synthetic Peptide
SNSPWQANRPTAPGTSWTPQAK

SEQ ID NO: 2203 - protein, 26 aa, Artificial Sequence
  Synthetic Peptide
LLDDGFGMDPFPDDLTAPWPEWALPR

SEQ ID NO: 2204 - protein, 10 aa, Artificial Sequence
  Synthetic Peptide
LSSAWPGTLR

SEQ ID NO: 2205 - protein, 6 aa, Artificial Sequence
  Synthetic Peptide
SGMVPR

SEQ ID NO: 2206 - protein, 13 aa, Artificial Sequence
  Synthetic Peptide
SGMVPRGPPATAR

SEQ ID NO: 2207 - protein, 15 aa, Artificial Sequence
  Synthetic Peptide
GPPATARFGVPAEGR

SEQ ID NO: 2208 - protein, 19 aa, Artificial Sequence
  Synthetic Peptide
FGVPAEGRSPPPFPGEPWK

SEQ ID NO: 2209 - protein, 10 aa, Artificial Sequence
  Synthetic Peptide
DLLINPDQPR

SEQ ID NO: 2210 - protein, 18 aa, Artificial Sequence
  Synthetic Peptide
DPLDFPRLPDPQALFPTR

SEQ ID NO: 2211 - protein, 10 aa, Artificial Sequence
  Synthetic Peptide
RGTSTGIISK

SEQ ID NO: 2212 - protein, 10 aa, Artificial Sequence
  Synthetic Peptide
RGASGSIFSK

SEQ ID NO: 2213 - protein, 10 aa, Artificial Sequence
  Synthetic Peptide
SRGSTNLFSK

SEQ ID NO: 2214 - protein, 10 aa, Artificial Sequence
  Synthetic Peptide
TWRGGSPEIK

SEQ ID NO: 2215 - protein, 19 aa, Artificial Sequence
  Synthetic Peptide
SFSEDREDGWGQSLGDRGR

SEQ ID NO: 2216 - protein, 21 aa, Artificial Sequence
  Synthetic Peptide
QQQQQQQILPGDRKPLYHYGR

SEQ ID NO: 2217 - protein, 8 aa, Artificial Sequence
  Synthetic Peptide
KPLYHYGR

SEQ ID NO: 2218 - protein, 21 aa, Artificial Sequence
  Synthetic Peptide
AQMVFSPPLSGSDTYPRGPTK

SEQ ID NO: 2219 - protein, 8 aa, Artificial Sequence
  Synthetic Peptide
PARGLYSR

SEQ ID NO: 2220 - protein, 13 aa, Artificial Sequence
  Synthetic Peptide
FNRGAYCGQCSER

SEQ ID NO: 2221 - protein, 8 aa, Artificial Sequence
  Synthetic Peptide
YDQAQFGR

SEQ ID NO: 2222 - protein, 10 aa, Artificial Sequence
  Synthetic Peptide
YDQAQFGRGR

SEQ ID NO: 2223 - protein, 21 aa, Artificial Sequence
  Synthetic Peptide
HSLTGHSDIRLPPAEFAQLIK

SEQ ID NO: 2224 - protein, 21 aa, Artificial Sequence
  Synthetic Peptide
SQGRGSSCSSSETSDDDSESR

SEQ ID NO: 2225 - protein, 11 aa, Artificial Sequence
  Synthetic Peptide
RGSSAESALPR

SEQ ID NO: 2226 - protein, 14 aa, Artificial Sequence
  Synthetic Peptide
LTRGGLGEGEYAQR

SEQ ID NO: 2227 - protein, 10 aa, Artificial Sequence
  Synthetic Peptide
LLRGGPEDGK

SEQ ID NO: 2228 - protein, 12 aa, Artificial Sequence
  Synthetic Peptide
SSSFSQGEAEPR

SEQ ID NO: 2229 - protein, 24 aa, Artificial Sequence
  Synthetic Peptide
VGAGRGVLVTGDGAGAPVFLRPLK

SEQ ID NO: 2230 - protein, 24 aa, Artificial Sequence
  Synthetic Peptide
QPALLAPPGPPNWLGPPTQSGTPR

SEQ ID NO: 2231 - protein, 12 aa, Artificial Sequence
  Synthetic Peptide
APLTYNQGSVPR

SEQ ID NO: 2232 - protein, 25 aa, Artificial Sequence
  Synthetic Peptide
LYVEPAAPFSAPTYMPTPEAVSRIR

SEQ ID NO: 2233 - protein, 9 aa, Artificial Sequence
  Synthetic Peptide
MSPAMSPAR

SEQ ID NO: 2234 - protein, 12 aa, Artificial Sequence
  Synthetic Peptide
SRSPTPPSIAAK

SEQ ID NO: 2235 - protein, 20 aa, Artificial Sequence
  Synthetic Peptide
AQLARQQSPSPIRHSPSPVR

SEQ ID NO: 2236 - protein, 20 aa, Artificial Sequence
  Synthetic Peptide
AQLARQQSPSPIRHSPSPVR

SEQ ID NO: 2237 - protein, 15 aa, Artificial Sequence
  Synthetic Peptide
QQSPSPIRHSPSPVR

SEQ ID NO: 2238 - protein, 8 aa, Artificial Sequence
  Synthetic Peptide
HSPSPVRH

SEQ ID NO: 2239 - protein, 11 aa, Artificial Sequence
  Synthetic Peptide
HVRAPTPSPVR

SEQ ID NO: 2240 - protein, 11 aa, Artificial Sequence
  Synthetic Peptide
HVRAPTPSPVR

SEQ ID NO: 2241 - protein, 13 aa, Artificial Sequence
  Synthetic Peptide
TPSPVRSVSPAGR

SEQ ID NO: 2242 - protein, 7 aa, Artificial Sequence
  Synthetic Peptide
SVSPAGR

SEQ ID NO: 2243 - protein, 17 aa, Artificial Sequence
  Synthetic Peptide
SVSPAGRISTSPIRSVK

SEQ ID NO: 2244 - protein, 10 aa, Artificial Sequence
  Synthetic Peptide
ISTSPIRSVK

SEQ ID NO: 2245 - protein, 22 aa, Artificial Sequence
  Synthetic Peptide
DAPGALMEAGRGTGSAGMAEPR

SEQ ID NO: 2246 - protein, 22 aa, Artificial Sequence
  Synthetic Peptide
DAPGALMEAGRGTGSAGMAEPR

SEQ ID NO: 2247 - protein, 13 aa, Artificial Sequence
  Synthetic Peptide
GIRGSSAARPSGR

SEQ ID NO: 2248 - protein, 20 aa, Artificial Sequence
  Synthetic Peptide
TASSSSVVPYLPRLPLLPSK

SEQ ID NO: 2249 - protein, 13 aa, Artificial Sequence
  Synthetic Peptide
YATPQVIQAPGPR

SEQ ID NO: 2250 - protein, 22 aa, Artificial Sequence
  Synthetic Peptide
RGAGRGGGAPPWQPASAPPAPH

SEQ ID NO: 2251 - protein, 44 aa, Artificial Sequence
  Synthetic Peptide
GAGRGGGAPPWQPASAPPAPHTNPSNPFYEALSTPSVLPVISAR

SEQ ID NO: 2252 - protein, 7 aa, Artificial Sequence
  Synthetic Peptide
PPPSPLR

SEQ ID NO: 2253 - protein, 27 aa, Artificial Sequence
  Synthetic Peptide
HNPCESLRGHPAGMTYAANILPHHPAR

SEQ ID NO: 2254 - protein, 12 aa, Artificial Sequence
  Synthetic Peptide
MCPYGRGGGQAR

SEQ ID NO: 2255 - protein, 18 aa, Artificial Sequence
  Synthetic Peptide
SVSPPGYAAQTAASPAPR

SEQ ID NO: 2256 - protein, 15 aa, Artificial Sequence
  Synthetic Peptide
FIHGHRGGGGGGVSR

SEQ ID NO: 2257 - protein, 8 aa, Artificial Sequence
  Synthetic Peptide
RTRVPPSR

SEQ ID NO: 2258 - protein, 24 aa, Artificial Sequence
  Synthetic Peptide
RGPGAAGPGASGSGHGEERGGGAK

SEQ ID NO: 2259 - protein, 12 aa, Artificial Sequence
  Synthetic Peptide
ADTRLPAFLSLR

SEQ ID NO: 2260 - protein, 8 aa, Artificial Sequence
  Synthetic Peptide
LPAFLSLR

SEQ ID NO: 2261 - protein, 32 aa, Artificial Sequence
  Synthetic Peptide
ARAGSAFLNPEGDSSTEAENDPQLTFYTDPSR

SEQ ID NO: 2262 - protein, 9 aa, Artificial Sequence
  Synthetic Peptide
SRGGISFGR

SEQ ID NO: 2263 - protein, 12 aa, Artificial Sequence
  Synthetic Peptide
RGQILWFRGLNR

SEQ ID NO: 2264 - protein, 11 aa, Artificial Sequence
  Synthetic Peptide
GQILWFRGLNR

SEQ ID NO: 2265 - protein, 11 aa, Artificial Sequence
  Synthetic Peptide
GQILWFRGLNR

SEQ ID NO: 2266 - protein, 11 aa, Artificial Sequence
  Synthetic Peptide
GQILWFRGLNR

SEQ ID NO: 2267 - protein, 8 aa, Artificial Sequence
  Synthetic Peptide
RGQILWVR

SEQ ID NO: 2268 - protein, 11 aa, Artificial Sequence
  Synthetic Peptide
GQILWVRGLNR

SEQ ID NO: 2269 - protein, 13 aa, Artificial Sequence
  Synthetic Peptide
AVDSLVPIGRGQR

SEQ ID NO: 2270 - protein, 9 aa, Artificial Sequence
  Synthetic Peptide
AQRPLRGAK

SEQ ID NO: 2271 - protein, 12 aa, Artificial Sequence
  Synthetic Peptide
FSHSVQNSERGK

SEQ ID NO: 2272 - protein, 8 aa, Artificial Sequence
  Synthetic Peptide
QLPWEDGR

SEQ ID NO: 2273 - protein, 15 aa, Artificial Sequence
  Synthetic Peptide
RGAHDAYSESEDDWC

SEQ ID NO: 2274 - protein, 28 aa, Artificial Sequence
  Synthetic Peptide
YGAGGGGSGPAAGVVVGAAGGRGAGGSR

SEQ ID NO: 2275 - protein, 28 aa, Artificial Sequence
  Synthetic Peptide
YGAGGGGSGPAAGVVVGAAGGRGAGGSR

SEQ ID NO: 2276 - protein, 15 aa, Artificial Sequence
  Synthetic Peptide
ATLEQTQPAVLRGAR

SEQ ID NO: 2277 - protein, 22 aa, Artificial Sequence
  Synthetic Peptide
ARGGGAGGAGGPGQGGLPPGQR

SEQ ID NO: 2278 - protein, 26 aa, Artificial Sequence
  Synthetic Peptide
RGGPGPGMMCGAVSDLLSDTEEDDKC

SEQ ID NO: 2279 - protein, 27 aa, Artificial Sequence
  Synthetic Peptide
SCHGNCDPIQQEAGGGETVVTFEDRAR

SEQ ID NO: 2280 - protein, 27 aa, Artificial Sequence
  Synthetic Peptide
SCHGNCDPIQQEAGGGETVVTFEDRAR

SEQ ID NO: 2281 - protein, 9 aa, Artificial Sequence
  Synthetic Peptide
GLFSLRGLR

SEQ ID NO: 2282 - protein, 13 aa, Artificial Sequence
  Synthetic Peptide
NRGSPGGCSHDSR

SEQ ID NO: 2283 - protein, 18 aa, Artificial Sequence
  Synthetic Peptide
TVLELQYVLDKLGDDDVR

SEQ ID NO: 2284 - protein, 30 aa, Artificial Sequence; identical to SEQ ID NO: 1562
  Synthetic Peptide

SEQ ID NO: 2285 - protein, 16 aa, Artificial Sequence
  Synthetic Peptide
VLTQPSQSAVRGGPGR

SEQ ID NO: 2286 - protein, 22 aa, Artificial Sequence
  Synthetic Peptide
YDSRGKHDFIGDFTTTFAEMQK

SEQ ID NO: 2287 - protein, 20 aa, Artificial Sequence
  Synthetic Peptide
FELLEKDPYALDVPNTAFGR

SEQ ID NO: 2288 - protein, 25 aa, Artificial Sequence
  Synthetic Peptide
AFLSPPTLLEGPLRLSPLLPGGGGR

SEQ ID NO: 2289 - protein, 14 aa, Artificial Sequence
  Synthetic Peptide
LSPLLPGGGGRGSR

SEQ ID NO: 2290 - protein, 22 aa, Artificial Sequence
  Synthetic Peptide
DNLGNSNVPDSPIPAECEAAGR

SEQ ID NO: 2291 - protein, 20 aa, Artificial Sequence
  Synthetic Peptide
GFFPPPFPPVRDPLFPVDPR

SEQ ID NO: 2292 - protein, 9 aa, Artificial Sequence
  Synthetic Peptide
DPLFPVDPR

SEQ ID NO: 2293 - protein, 19 aa, Artificial Sequence
  Synthetic Peptide
DYFPPRDFPGPPLPPFPGR

SEQ ID NO: 2294 - protein, 18 aa, Artificial Sequence
  Synthetic Peptide
PRAGVQWVPTYRPEMYQY

SEQ ID NO: 2295 - protein, 32 aa, Artificial Sequence
  Synthetic Peptide
SLYEYSKDFVVSLILGMDVIPRLSVTNMEDLK

SEQ ID NO: 2296 - protein, 26 aa, Artificial Sequence
  Synthetic Peptide
GRGGPGDISPVMLPNSQPDLPDVWLR

SEQ ID NO: 2297 - protein, 21 aa, Artificial Sequence
  Synthetic Peptide
EMQDLGGGERTTGFELMDGVK

SEQ ID NO: 2298 - protein, 36 aa, Artificial Sequence
  Synthetic Peptide
AMNDIGDYVGSNLEISWLPNLDGLMEGYARNFRPGI

SEQ ID NO: 2299 - protein, 6 aa, Artificial Sequence
  Synthetic Peptide
IQASFR

SEQ ID NO: 2300 - protein, 18 aa, Artificial Sequence
  Synthetic Peptide
LFQRPRGRHPSLVSAPHR

SEQ ID NO: 2301 - protein, 17 aa, Artificial Sequence
  Synthetic Peptide
PVTPGITLSSNPSVNSR

SEQ ID NO: 2302 - protein, 9 aa, Artificial Sequence
  Synthetic Peptide
HRGGDLGTR

SEQ ID NO: 2303 - protein, 18 aa, Artificial Sequence
  Synthetic Peptide
VWFVVDPSHSVVDFQDQR

SEQ ID NO: 2304 - protein, 9 aa, Artificial Sequence
  Synthetic Peptide
RGSSGETLR

SEQ ID NO: 2305 - protein, 10 aa, Artificial Sequence
  Synthetic Peptide
STRGQHLWQR

SEQ ID NO: 2306 - protein, 12 aa, Artificial Sequence
  Synthetic Peptide
PLVGPLALGSPR

SEQ ID NO: 2307 - protein, 7 aa, Artificial Sequence
  Synthetic Peptide
AGPLLAR

SEQ ID NO: 2308 - protein, 32 aa, Artificial Sequence
  Synthetic Peptide
SPQAAQPPPPLPGARGGLGLLEHFLPPPPSSR

SEQ ID NO: 2309 - protein, 16 aa, Artificial Sequence
  Synthetic Peptide
YVAIQNPIHHSRFNSR

SEQ ID NO: 2310 - protein, 16 aa, Artificial Sequence
  Synthetic Peptide
VHSGRGAEVESSQPLR

SEQ ID NO: 2311 - protein, 17 aa, Artificial Sequence
  Synthetic Peptide
TLVVTANRGSSPQVLPR

SEQ ID NO: 2312 - protein, 16 aa, Artificial Sequence
  Synthetic Peptide
WQERPMQPLVSQGQLR

SEQ ID NO: 2313 - protein, 19 aa, Artificial Sequence
  Synthetic Peptide
AHGAFYQDGSLDEYYGRGR

SEQ ID NO: 2314 - protein, 18 aa, Artificial Sequence
  Synthetic Peptide
QARPESSSRGGSLETPSK

SEQ ID NO: 2315 - protein, 18 aa, Artificial Sequence
  Synthetic Peptide
QARPESSSRGGSLETPSK

SEQ ID NO: 2316 - protein, 33 aa, Artificial Sequence
  Synthetic Peptide
AGASEGEDEDDAADEDALPPYSELELSRGELSR

SEQ ID NO: 2317 - protein, 33 aa, Artificial Sequence; identical to SEQ ID NO: 2316
  Synthetic Peptide

SEQ ID NO: 2318 - protein, 7 aa, Artificial Sequence
  Synthetic Peptide
YWNSLFR

SEQ ID NO: 2319 - protein, 28 aa, Artificial Sequence
  Synthetic Peptide
GGFALTLLATAEAARPQGLFTRGTLLGR

SEQ ID NO: 2320 - protein, 22 aa, Artificial Sequence
  Synthetic Peptide
GGFALTLLATAEAARPQGLFTR

SEQ ID NO: 2321 - protein, 28 aa, Artificial Sequence
  Synthetic Peptide
GGFALTLLATAEAARPQGLFTRGTLLGR

SEQ ID NO: 2322 - protein, 15 aa, Artificial Sequence
  Synthetic Peptide
GAYSSHDPQGSRGSR

SEQ ID NO: 2323 - protein, 15 aa, Artificial Sequence
  Synthetic Peptide
GAYSSHDPQGSRGSR

SEQ ID NO: 2324 - protein, 17 aa, Artificial Sequence
  Synthetic Peptide
NRPSFDGILYYYQSGGR

SEQ ID NO: 2325 - protein, 12 aa, Artificial Sequence
  Synthetic Peptide
QTGSPGMIYSTR

SEQ ID NO: 2326 - protein, 40 aa, Artificial Sequence
  Synthetic Peptide
THPGLLRGGAGGLGIMGLPPLPAPGEPCPLAQEEVIETNR

SEQ ID NO: 2327 - protein, 25 aa, Artificial Sequence
  Synthetic Peptide
QYQELPRCPAPAPSLLNIPLSSPGR

SEQ ID NO: 2328 - protein, 16 aa, Artificial Sequence
  Synthetic Peptide
NSMRRNNSMRRNNSIR

SEQ ID NO: 2329 - protein, 10 aa, Artificial Sequence
  Synthetic Peptide
LTRGGPSSTK

SEQ ID NO: 2330 - protein, 26 aa, Artificial Sequence
  Synthetic Peptide
HSTLLSVPDSTLASMFSPSSPRGGAR

SEQ ID NO: 2331 - protein, 26 aa, Artificial Sequence
  Synthetic Peptide
HSTLLSVPDSTLASMFSPSSPRGGAR

SEQ ID NO: 2332 - protein, 16 aa, Artificial Sequence
  Synthetic Peptide
GTMGNHLLTNPVLQPR

SEQ ID NO: 2333 - protein, 20 aa, Artificial Sequence
  Synthetic Peptide
IDRAAMDGSERTTLVPNVGR

SEQ ID NO: 2334 - protein, 5 aa, Artificial Sequence
  Synthetic Peptide
HYIIR

SEQ ID NO: 2335 - protein, 20 aa, Artificial Sequence
  Synthetic Peptide
AGAGAGAGARGGAPAGVEAR

SEQ ID NO: 2336 - protein, 26 aa, Artificial Sequence
  Synthetic Peptide
RGGGVGADPAEALRPACPPDYTLALR

SEQ ID NO: 2337 - protein, 18 aa, Artificial Sequence
  Synthetic Peptide
MDSRARSSSREAHGRSSR

SEQ ID NO: 2338 - protein, 15 aa, Artificial Sequence
  Synthetic Peptide
TPSSFRQPFVTPSSR

SEQ ID NO: 2339 - protein, 14 aa, Artificial Sequence
  Synthetic Peptide
RGPLVGIGPTSTPR

SEQ ID NO: 2340 - protein, 14 aa, Artificial Sequence
  Synthetic Peptide
RGPLVGIGPTSTPR

SEQ ID NO: 2341 - protein, 20 aa, Artificial Sequence
  Synthetic Peptide
RGLSLGSAVNSPVLFSPAGR

SEQ ID NO: 2342 - protein, 8 aa, Artificial Sequence
  Synthetic Peptide
YMRPTSSR

SEQ ID NO: 2343 - protein, 9 aa, Artificial Sequence
  Synthetic Peptide
LQQRGAGVK

SEQ ID NO: 2344 - protein, 14 aa, Artificial Sequence
  Synthetic Peptide
EQCRGTGGYQPLDR

SEQ ID NO: 2345 - protein, 17 aa, Artificial Sequence
  Synthetic Peptide
SRSFTSSYAVSAANHVK

SEQ ID NO: 2346 - protein, 9 aa, Artificial Sequence
  Synthetic Peptide
SRGPSQVDR

SEQ ID NO: 2347 - protein, 21 aa, Artificial Sequence
  Synthetic Peptide
SRGPSQVDREGPGTPPTTLAR

SEQ ID NO: 2348 - protein, 13 aa, Artificial Sequence
  Synthetic Peptide
SASSSAVSSVGAR

SEQ ID NO: 2349 - protein, 14 aa, Artificial Sequence
  Synthetic Peptide
GLGSYRGAAHLSGR

SEQ ID NO: 2350 - protein, 13 aa, Artificial Sequence
  Synthetic Peptide
SSTLGGRGQLHSR

SEQ ID NO: 2351 - protein, 15 aa, Artificial Sequence
  Synthetic Peptide
AHGGHPGSPRGSLSR

SEQ ID NO: 2352 - protein, 25 aa, Artificial Sequence
  Synthetic Peptide
NAAGEAGLPVTPGSGPWGSAASLGR

SEQ ID NO: 2353 - protein, 27 aa, Artificial Sequence
  Synthetic Peptide
MSRGSVGPAPSLSELDLRPPSPINLSR

SEQ ID NO: 2354 - protein, 15 aa, Artificial Sequence
  Synthetic Peptide
IITGPAPVLPPAALR

SEQ ID NO: 2355 - protein, 29 aa, Artificial Sequence
  Synthetic Peptide
IITGPAPVLPPAALRTPTPAGPTIMPLIR

SEQ ID NO: 2356 - protein, 14 aa, Artificial Sequence
  Synthetic Peptide
TPTPAGPTIMPLIR

SEQ ID NO: 2357 - protein, 14 aa, Artificial Sequence
  Synthetic Peptide
GRSSSLGLQEYNSR

SEQ ID NO: 2358 - protein, 13 aa, Artificial Sequence
  Synthetic Peptide
MQPPRERLVVTGR

SEQ ID NO: 2359 - protein, 16 aa, Artificial Sequence
  Synthetic Peptide
SGGASPWWAAGGRGSR

SEQ ID NO: 2360 - protein, 14 aa, Artificial Sequence
  Synthetic Peptide
GTPGRGSSPSSSVY

SEQ ID NO: 2361 - protein, 19 aa, Artificial Sequence
  Synthetic Peptide
YSSPHQSLLSIRGSLFSPR

SEQ ID NO: 2362 - protein, 19 aa, Artificial Sequence
  Synthetic Peptide
FSSPHQSLLSIRGSLFSPR

SEQ ID NO: 2363 - protein, 19 aa, Artificial Sequence
  Synthetic Peptide
FSSPHQSLLSIRGSLFSPR

SEQ ID NO: 2364 - protein, 20 aa, Artificial Sequence
  Synthetic Peptide
FSSPHQSLLSIRGSLFSPRR

SEQ ID NO: 2365 - protein, 10 aa, Artificial Sequence
  Synthetic Peptide
SSRGSIFTFR

SEQ ID NO: 2366 - protein, 32 aa, Artificial Sequence
  Synthetic Peptide
GTGPGGRGGAGGGPGGPPEALLAPLMQNGWTK

SEQ ID NO: 2367 - protein, 9 aa, Artificial Sequence
  Synthetic Peptide
GRGGNESVM

SEQ ID NO: 2368 - protein, 16 aa, Artificial Sequence
  Synthetic Peptide
LQRGGSSASLHNSLMR

SEQ ID NO: 2369 - protein, 16 aa, Artificial Sequence
  Synthetic Peptide
MELRRGGVGNQAAGRR

SEQ ID NO: 2370 - protein, 8 aa, Artificial Sequence
  Synthetic Peptide
TAVAPLDR

SEQ ID NO: 2371 - protein, 15 aa, Artificial Sequence
  Synthetic Peptide
RPEGFDGLGYRGGVR

SEQ ID NO: 2372 - protein, 20 aa, Artificial Sequence
  Synthetic Peptide
ENMPEGKWPNWMTGGPETPR

SEQ ID NO: 2373 - protein, 16 aa, Artificial Sequence
  Synthetic Peptide
IQGGRGSPSGLAPILR

SEQ ID NO: 2374 - protein, 23 aa, Artificial Sequence
  Synthetic Peptide
DHTHLSPGTANSHWCIQFNRGGR

SEQ ID NO: 2375 - protein, 41 aa, Artificial Sequence
  Synthetic Peptide
TDALEASSLLSSGVDCGLEEASLHSSFNLGPRFPASNTYEK

SEQ ID NO: 2376 - protein, 22 aa, Artificial Sequence
  Synthetic Peptide
GAEDLLRFTVPIPALNNSPQLK

SEQ ID NO: 2377 - protein, 12 aa, Artificial Sequence
  Synthetic Peptide
LTEPQLGLGSQR

SEQ ID NO: 2378 - protein, 21 aa, Artificial Sequence
  Synthetic Peptide
QFIADNFCMRGLSNFYPDLTK

SEQ ID NO: 2379 - protein, 21 aa, Artificial Sequence
  Synthetic Peptide
SALLDDHLHSEPYWSGDLRGR

SEQ ID NO: 2380 - protein, 23 aa, Artificial Sequence
  Synthetic Peptide
QLFCMILIVIFVAMLGMLSPSSR

SEQ ID NO: 2381 - protein, 19 aa, Artificial Sequence
  Synthetic Peptide
NGYVNPAYTRRISPVCPDR

SEQ ID NO: 2382 - protein, 12 aa, Artificial Sequence
  Synthetic Peptide
SRGAIISQYYNR

SEQ ID NO: 2383 - protein, 14 aa, Artificial Sequence
  Synthetic Peptide
RGASLHSSGGSGGR

SEQ ID NO: 2384 - protein, 11 aa, Artificial Sequence
  Synthetic Peptide
DIVENICRGGK

SEQ ID NO: 2385 - protein, 32 aa, Artificial Sequence
  Synthetic Peptide
GPPDFSSDEEREPTPVLGSGASVGRGRGAVGR

SEQ ID NO: 2386 - protein, 32 aa, Artificial Sequence; identical to SEQ ID NO: 2385
  Synthetic Peptide

SEQ ID NO: 2387 - protein, 25 aa, Artificial Sequence
  Synthetic Peptide
GPPDFSSDEEREPTPVLGSGASVGR

SEQ ID NO: 2388 - protein, 27 aa, Artificial Sequence
  Synthetic Peptide
GPPDFSSDEEREPTPVLGSGASVGRGR

SEQ ID NO: 2389 - protein, 32 aa, Artificial Sequence; identical to SEQ ID NO: 2385
  Synthetic Peptide

SEQ ID NO: 2390 - protein, 27 aa, Artificial Sequence
  Synthetic Peptide
GPPDFSSDEEREPTPVLGSGASVGRGR

SEQ ID NO: 2391 - protein, 32 aa, Artificial Sequence; identical to SEQ ID NO: 2385
  Synthetic Peptide

SEQ ID NO: 2392 - protein, 22 aa, Artificial Sequence
  Synthetic Peptide
LYGLVALVLLLLIAACVPIFTR

SEQ ID NO: 2393 - protein, 33 aa, Artificial Sequence
  Synthetic Peptide
DRGSGQVHSGAAADQELCIDQAVVFIEDAIKYR

SEQ ID NO: 2394 - protein, 27 aa, Artificial Sequence
  Synthetic Peptide
RQSVGRGLQLTPGIGGMQQHFFDDEDR

SEQ ID NO: 2395 - protein, 18 aa, Artificial Sequence
  Synthetic Peptide
TDGFAEAIHSPQVAGVPR

SEQ ID NO: 2396 - protein, 20 aa, Artificial Sequence
  Synthetic Peptide
TDGFAEAIHSPQVAGVPRFR

SEQ ID NO: 2397 - protein, 14 aa, Artificial Sequence
  Synthetic Peptide
LGNDTEATKYRNLR

SEQ ID NO: 2398 - protein, 14 aa, Artificial Sequence
  Synthetic Peptide
LGNDTEATKYRNLR

SEQ ID NO: 2399 - protein, 16 aa, Artificial Sequence
  Synthetic Peptide
SEELREFASGSPLTLK

SEQ ID NO: 2400 - protein, 21 aa, Artificial Sequence
  Synthetic Peptide
AAVAAGMGLSDGPASSGRGCR

SEQ ID NO: 2401 - protein, 21 aa, Artificial Sequence
  Synthetic Peptide
AAVAAGMGLSDGPASSGRGCR

SEQ ID NO: 2402 - protein, 21 aa, Artificial Sequence
  Synthetic Peptide
AAVAAGMGLSDGPASSGRGCR

SEQ ID NO: 2403 - protein, 23 aa, Artificial Sequence
  Synthetic Peptide
SIGSASPGPGQPPLSSPTRGGVK

SEQ ID NO: 2404 - protein, 12 aa, Artificial Sequence
  Synthetic Peptide
RGGDHMTLQPLR

SEQ ID NO: 2405 - protein, 17 aa, Artificial Sequence
  Synthetic Peptide
AAYYPPSQIAQLRPSPR

SEQ ID NO: 2406 - protein, 8 aa, Artificial Sequence
  Synthetic Peptide
PASSQVPR

SEQ ID NO: 2407 - protein, 8 aa, Artificial Sequence
  Synthetic Peptide
TAAQARRR

SEQ ID NO: 2408 - protein, 18 aa, Artificial Sequence
  Synthetic Peptide
GGYEDPYYGYEDFQVGAR

SEQ ID NO: 2409 - protein, 12 aa, Artificial Sequence
  Synthetic Peptide
GRGQGGNWQALK

SEQ ID NO: 2410 - protein, 12 aa, Artificial Sequence
  Synthetic Peptide
CVEGQLLRGLSR

SEQ ID NO: 2411 - protein, 15 aa, Artificial Sequence
  Synthetic Peptide
EGTRGSSWSAQNTPR

SEQ ID NO: 2412 - protein, 17 aa, Artificial Sequence
  Synthetic Peptide
ALNSDMPLYILSSSQGR

SEQ ID NO: 2413 - protein, 28 aa, Artificial Sequence
  Synthetic Peptide
ALNSDMPLYILSSSQGRGLKPHYAQLMR

SEQ ID NO: 2414 - protein, 10 aa, Artificial Sequence
  Synthetic Peptide
GGRGGGLHLR

SEQ ID NO: 2415 - protein, 14 aa, Artificial Sequence
  Synthetic Peptide
SGGYGGSRDYYASR

SEQ ID NO: 2416 - protein, 7 aa, Artificial Sequence
  Synthetic Peptide
RGGYVPR

SEQ ID NO: 2417 - protein, 19 aa, Artificial Sequence
  Synthetic Peptide
HHSSSHSRSSWSLSPSRSR

SEQ ID NO: 2418 - protein, 10 aa, Artificial Sequence
  Synthetic Peptide
GPPLDARGGR

SEQ ID NO: 2419 - protein, 8 aa, Artificial Sequence
  Synthetic Peptide
FERGGNSR

SEQ ID NO: 2420 - protein, 16 aa, Artificial Sequence
  Synthetic Peptide
LMQLVDHRGGGGGGGK

SEQ ID NO: 2421 - protein, 8 aa, Artificial Sequence
  Synthetic Peptide
NFRGQGQR

SEQ ID NO: 2422 - protein, 12 aa, Artificial Sequence
  Synthetic Peptide
NFRGQGQRGGSR

SEQ ID NO: 2423 - protein, 12 aa, Artificial Sequence
  Synthetic Peptide
RYAGPLHHQTQR

SEQ ID NO: 2424 - protein, 10 aa, Artificial Sequence
  Synthetic Peptide
NRGNWLQDNR

SEQ ID NO: 2425 - protein, 23 aa, Artificial Sequence
  Synthetic Peptide
QNHPLPFPPPPALPFYPASVYPR

SEQ ID NO: 2426 - protein, 11 aa, Artificial Sequence
  Synthetic Peptide
PRGVISTPVIR

SEQ ID NO: 2427 - protein, 11 aa, Artificial Sequence
  Synthetic Peptide
PRGVISTPVIR

SEQ ID NO: 2428 - protein, 15 aa, Artificial Sequence
  Synthetic Peptide
GGFGGGRGGFGGGGR

SEQ ID NO: 2429 - protein, 8 aa, Artificial Sequence
  Synthetic Peptide
FRGQAEDR

SEQ ID NO: 2430 - protein, 22 aa, Artificial Sequence
  Synthetic Peptide
QIGLGFRPPGSGRGGSGGGSDK

SEQ ID NO: 2431 - protein, 11 aa, Artificial Sequence
  Synthetic Peptide
TYGGSYGGRGR

SEQ ID NO: 2432 - protein, 16 aa, Artificial Sequence
  Synthetic Peptide
RGFGFVYFQSHDAADK

SEQ ID NO: 2433 - protein, 14 aa, Artificial Sequence
  Synthetic Peptide
SGGGGGGGGSWGGR

SEQ ID NO: 2434 - protein, 21 aa, Artificial Sequence
  Synthetic Peptide
GGNFGGRSSGPYGGGGQYFAK

SEQ ID NO: 2435 - protein, 20 aa, Artificial Sequence
  Synthetic Peptide
PRNQGGYGGSSSSSSYGSGR

SEQ ID NO: 2436 - protein, 38 aa, Artificial Sequence
  Synthetic Peptide
GGSDGYGSGRGFGDGYNGYGGGPGGGNFGGSPGYGGGR

SEQ ID NO: 2437 - protein, 25 aa, Artificial Sequence
  Synthetic Peptide
GGGGNFGPGPGSNFRGGSDGYGSGR

SEQ ID NO: 2438 - protein, 25 aa, Artificial Sequence
  Synthetic Peptide
GGGGNFGPGPGSNFRGGSDGYGSGR

SEQ ID NO: 2439 - protein, 33 aa, Artificial Sequence
  Synthetic Peptide
SGNFGGSRNMGGPYGGGNYGPGGSGGSGGYGGR

SEQ ID NO: 2440 - protein, 33 aa, Artificial Sequence; identical to SEQ ID NO: 2439
  Synthetic Peptide

SEQ ID NO: 2441 - protein, 25 aa, Artificial Sequence
  Synthetic Peptide
NMGGPYGGGNYGPGGSGGSGGYGGR

SEQ ID NO: 2442 - protein, 10 aa, Artificial Sequence
  Synthetic Peptide
QEMQSAGSQR

SEQ ID NO: 2443 - protein, 12 aa, Artificial Sequence
  Synthetic Peptide
QEMQSAGSQRGR

SEQ ID NO: 2444 - protein, 12 aa, Artificial Sequence
  Synthetic Peptide
GRGGGSGNFMGR

SEQ ID NO: 2445 - protein, 29 aa, Artificial Sequence
  Synthetic Peptide
GGSFGGRSSGSPYGGGYGSGGGSGGYGSR

SEQ ID NO: 2446 - protein, 30 aa, Artificial Sequence
  Synthetic Peptide
GGSFGGRSSGSPYGGGYGSGGGSGGYGSRR

SEQ ID NO: 2447 - protein, 30 aa, Artificial Sequence; identical to SEQ ID NO: 2446
  Synthetic Peptide

SEQ ID NO: 2448 - protein, 23 aa, Artificial Sequence
  Synthetic Peptide
SSGSPYGGGYGSGGGSGGYGSRR

SEQ ID NO: 2449 - protein, 24 aa, Artificial Sequence
  Synthetic Peptide
SSGSPYGGGYGSGGGSGGYGSRRF

SEQ ID NO: 2450 - protein, 23 aa, Artificial Sequence
  Synthetic Peptide
SSGSPYGGGYGSGGGSGGYGSRR

SEQ ID NO: 2451 - protein, 22 aa, Artificial Sequence
  Synthetic Peptide
SRGFGFVTYSCVEEVDAAMCAR

SEQ ID NO: 2452 - protein, 22 aa, Artificial Sequence
  Synthetic Peptide
NRGNRGSGGGQSQSWNQGYGNY

SEQ ID NO: 2453 - protein, 20 aa, Artificial Sequence
  Synthetic Peptide
GNRGSGGGQSQSWNQGYGNY

SEQ ID NO: 2454 - protein, 18 aa, Artificial Sequence
  Synthetic Peptide
NRGNRGSGGGQGSTNYGK

SEQ ID NO: 2455 - protein, 16 aa, Artificial Sequence
  Synthetic Peptide
GNRGSGGGQGSTNYGK

SEQ ID NO: 2456 - protein, 16 aa, Artificial Sequence
  Synthetic Peptide
EVYQQQQYGSGGRGNR

SEQ ID NO: 2457 - protein, 17 aa, Artificial Sequence
  Synthetic Peptide
FMSVQRPGPYDRPGTAR

SEQ ID NO: 2458 - protein, 32 aa, Artificial Sequence
  Synthetic Peptide
RGGDGYDGGYGGFDDYGGYNNYGYGNDGFDDR

SEQ ID NO: 2459 - protein, 14 aa, Artificial Sequence
  Synthetic Peptide
DGMDNQGGYGSVGR

SEQ ID NO: 2460 - protein, 23 aa, Artificial Sequence
  Synthetic Peptide
GGGGSGGYYGQGGMSGGGWRGMY

SEQ ID NO: 2461 - protein, 26 aa, Artificial Sequence
  Synthetic Peptide
AQPYDPNFYDETYDYGGFTMMFDDRR

SEQ ID NO: 2462 - protein, 26 aa, Artificial Sequence
  Synthetic Peptide
AQPYDPNFYDETYDYGGFTMMFDDRR

SEQ ID NO: 2463 - protein, 39 aa, Artificial Sequence
  Synthetic Peptide
QPPLLGDHPAEYGGPHGGYHSHYHDEGYGPPPPHYEGRR

SEQ ID NO: 2464 - protein, 14 aa, Artificial Sequence
  Synthetic Peptide
STAYEDYYYHPPPR

SEQ ID NO: 2465 - protein, 10 aa, Artificial Sequence
  Synthetic Peptide
KRPFEENRGR

SEQ ID NO: 2466 - protein, 8 aa, Artificial Sequence
  Synthetic Peptide
GRGYFEHR

SEQ ID NO: 2467 - protein, 20 aa, Artificial Sequence
  Synthetic Peptide
GGFQNRGGGGGSGGGGGNYR

SEQ ID NO: 2468 - protein, 25 aa, Artificial Sequence
  Synthetic Peptide
GGFQNRGGGGGSGGGGGNYRGGFNR

SEQ ID NO: 2469 - protein, 13 aa, Artificial Sequence
  Synthetic Peptide
DNNNSNNRGNYNR

SEQ ID NO: 2470 - protein, 7 aa, Artificial Sequence
  Synthetic Peptide
YRGDYER

SEQ ID NO: 2471 - protein, 17 aa, Artificial Sequence
  Synthetic Peptide
QYNRDWQNYYYHHQQDR

SEQ ID NO: 2472 - protein, 12 aa, Artificial Sequence
  Synthetic Peptide
YYRNYYGYQGYR

SEQ ID NO: 2473 - protein, 12 aa, Artificial Sequence
  Synthetic Peptide
YYRNYYGYQGYR

SEQ ID NO: 2474 - protein, 9 aa, Artificial Sequence
  Synthetic Peptide
NYYGYQGYR

SEQ ID NO: 2475 - protein, 55 aa, Artificial Sequence
  Synthetic Peptide
AGGGGGAAGAGGGPPPGPPGAGDRGGGGPGGGGPGGGGASGGPSQPPGGGGPGIR

SEQ ID NO: 2476 - protein, 17 aa, Artificial Sequence
  Synthetic Peptide
SGPPGPPGAPGMPPGGR

SEQ ID NO: 2477 - protein, 19 aa, Artificial Sequence
  Synthetic Peptide
SGPPGPPGAPGMPPGGRGR

SEQ ID NO: 2478 - protein, 41 aa, Artificial Sequence
  Synthetic Peptide
SGPPGPPGAPGMPPGGRGRGRGQGNWGPPGGEMTFSIPTHK

SEQ ID NO: 2479 - protein, 13 aa, Artificial Sequence
  Synthetic Peptide
CGLVIGRGGENVK

SEQ ID NO: 2480 - protein, 20 aa, Artificial Sequence
  Synthetic Peptide
SDESGEEKNGDEDCQRGGQK

SEQ ID NO: 2481 - protein, 7 aa, Artificial Sequence
  Synthetic Peptide
GAAGKIR

SEQ ID NO: 2482 - protein, 11 aa, Artificial Sequence
  Synthetic Peptide
SNPTSPMAGRR

SEQ ID NO: 2483 - protein, 10 aa, Artificial Sequence
  Synthetic Peptide
EVMSPTGSAR

SEQ ID NO: 2484 - protein, 12 aa, Artificial Sequence
  Synthetic Peptide
EVMSPTGSARGR

SEQ ID NO: 2485 - protein, 9 aa, Artificial Sequence
  Synthetic Peptide
EVMFPPGTR

SEQ ID NO: 2486 - protein, 35 aa, Artificial Sequence
  Synthetic Peptide
GRGYPGFAPSYGYQFPGFPAAAYGPVAAAAVAAAR

SEQ ID NO: 2487 - protein, 33 aa, Artificial Sequence
  Synthetic Peptide
GYPGFAPSYGYQFPGFPAAAYGPVAAAAVAAAR

SEQ ID NO: 2488 - protein, 16 aa, Artificial Sequence
  Synthetic Peptide
DEYREDYDAGRGGYGK

SEQ ID NO: 2489 - protein, 12 aa, Artificial Sequence
  Synthetic Peptide
SGRGGSGVQSSR

SEQ ID NO: 2490 - protein, 40 aa, Artificial Sequence
  Synthetic Peptide
ALPASAILNQFQPAAGGYFVPAVPQAQGRPPYYTPNQLAQ

SEQ ID NO: 2491 - protein, 9 aa, Artificial Sequence
  Synthetic Peptide
WQQGGRPQG

SEQ ID NO: 2492 - protein, 18 aa, Artificial Sequence
  Synthetic Peptide
WQQGGRPQGFQGMPSALR

SEQ ID NO: 2493 - protein, 18 aa, Artificial Sequence
  Synthetic Peptide
WQQGGRPQGFQGMPSALR

SEQ ID NO: 2494 - protein, 15 aa, Artificial Sequence
  Synthetic Peptide
AAAGAAGGRGSGPGR

SEQ ID NO: 2495 - protein, 21 aa, Artificial Sequence
  Synthetic Peptide
AAAAAAAAAGAAGGRGSGPGR

SEQ ID NO: 2496 - protein, 13 aa, Artificial Sequence
  Synthetic Peptide
TSLALDESLFRGR

SEQ ID NO: 2497 - protein, 20 aa, Artificial Sequence
  Synthetic Peptide
NLNGTGDRGGHQSSHQDHLR

SEQ ID NO: 2498 - protein, 25 aa, Artificial Sequence
  Synthetic Peptide
ANPTTGSLEWLEEDEHYDYHQEIAR

SEQ ID NO: 2499 - protein, 24 aa, Artificial Sequence
  Synthetic Peptide
MRPGTGAERGGLMVSEMESQPPSR

SEQ ID NO: 2500 - protein, 20 aa, Artificial Sequence
  Synthetic Peptide
LSGSNLCSSSWVSADGFLRR

SEQ ID NO: 2501 - protein, 20 aa, Artificial Sequence
  Synthetic Peptide
LSGSNLCSSSWVSADGFLRR

SEQ ID NO: 2502 - protein, 24 aa, Artificial Sequence
  Synthetic Peptide
MRPGTGAERGGLMVSEMESQPPSR

SEQ ID NO: 2503 - protein, 16 aa, Artificial Sequence
  Synthetic Peptide
DGGGRGPDDLEGPDSK

SEQ ID NO: 2504 - protein, 23 aa, Artificial Sequence
  Synthetic Peptide
LLQGRPPLDFYPPGVHPSGLVPR

SEQ ID NO: 2505 - protein, 13 aa, Artificial Sequence
  Synthetic Peptide
KPARGGQGPPPPR

SEQ ID NO: 2506 - protein, 38 aa, Artificial Sequence
  Synthetic Peptide
TGSETPQAPMSGVGPVSGGPGGFGRGSQGGNFEGPNKR

SEQ ID NO: 2507 - protein, 22 aa, Artificial Sequence
  Synthetic Peptide
YRSASSASSLFSPSSTLFSSSR

SEQ ID NO: 2508 - protein, 12 aa, Artificial Sequence
  Synthetic Peptide
IDQKTPLRVLHR

SEQ ID NO: 2509 - protein, 20 aa, Artificial Sequence
  Synthetic Peptide
TRSHADDVGLVLSSLQASIY

SEQ ID NO: 2510 - protein, 26 aa, Artificial Sequence
  Synthetic Peptide
TRSHADDVGLVLSSLQASIYRGGYNR

SEQ ID NO: 2511 - protein, 36 aa, Artificial Sequence
  Synthetic Peptide
LNPVVGTVYGPEFYAVTSFPYPTTGTAVAYRGAHLR

SEQ ID NO: 2512 - protein, 36 aa, Artificial Sequence; identical to SEQ ID NO: 2511
  Synthetic Peptide

SEQ ID NO: 2513 - protein, 14 aa, Artificial Sequence
  Synthetic Peptide
YDSRPGGYGYGYGR

SEQ ID NO: 2514 - protein, 14 aa, Artificial Sequence
  Synthetic Peptide
YDSRPGGYGYGYGR

SEQ ID NO: 2515 - protein, 20 aa, Artificial Sequence
  Synthetic Peptide
SRGFGFITFTNPEHASDAMR

SEQ ID NO: 2516 - protein, 10 aa, Artificial Sequence
  Synthetic Peptide
GSRGGAFGGR

SEQ ID NO: 2517 - protein, 16 aa, Artificial Sequence
  Synthetic Peptide
TPGPRGSYLGGYSAGR

SEQ ID NO: 2518 - protein, 16 aa, Artificial Sequence
  Synthetic Peptide
GSYLGGYSAGRGIYSR

SEQ ID NO: 2519 - protein, 16 aa, Artificial Sequence
  Synthetic Peptide
GSYLGGYSAGRGIYSR

SEQ ID NO: 2520 - protein, 14 aa, Artificial Sequence
  Synthetic Peptide
MRGPGGGPPGRTSK

SEQ ID NO: 2521 - protein, 13 aa, Artificial Sequence
  Synthetic Peptide
LYVAQQMAPPSPR

SEQ ID NO: 2522 - protein, 17 aa, Artificial Sequence
  Synthetic Peptide
SAPPTRGPPPSYGGSSR

SEQ ID NO: 2523 - protein, 10 aa, Artificial Sequence
  Synthetic Peptide
RGPPPPPRSR

SEQ ID NO: 2524 - protein, 10 aa, Artificial Sequence
  Synthetic Peptide
GLRGGSGGTR

SEQ ID NO: 2525 - protein, 24 aa, Artificial Sequence
  Synthetic Peptide
GPPSRGGYMDDGGYSMNFNMSSSR

SEQ ID NO: 2526 - protein, 30 aa, Artificial Sequence
  Synthetic Peptide
GPPSRGGYMDDGGYSMNFNMSSSRGPLPVK

SEQ ID NO: 2527 - protein, 9 aa, Artificial Sequence
  Synthetic Peptide
RSTPSGPVR

SEQ ID NO: 2528 - protein, 10 aa, Artificial Sequence
  Synthetic Peptide
NRPAPYSRPK

SEQ ID NO: 2529 - protein, 13 aa, Artificial Sequence
  Synthetic Peptide
MAGGRDRGDLAAR

SEQ ID NO: 2530 - protein, 22 aa, Artificial Sequence
  Synthetic Peptide
NRGFGQSNSLPTASSVGSGMGR

SEQ ID NO: 2531 - protein, 13 aa, Artificial Sequence
  Synthetic Peptide
SGWTSASSWAVRK

SEQ ID NO: 2532 - protein, 14 aa, Artificial Sequence
  Synthetic Peptide
KQTSGTSNTRGSRR

SEQ ID NO: 2533 - protein, 21 aa, Artificial Sequence
  Synthetic Peptide
RGGSGSHNWGTVKDELTESPK

SEQ ID NO: 2534 - protein, 11 aa, Artificial Sequence
  Synthetic Peptide
GMGRGDGFDSR

SEQ ID NO: 2535 - protein, 11 aa, Artificial Sequence
  Synthetic Peptide
GRGDGFDSRGK

SEQ ID NO: 2536 - protein, 7 aa, Artificial Sequence
  Synthetic Peptide
GDGFDSR

SEQ ID NO: 2537 - protein, 25 aa, Artificial Sequence
  Synthetic Peptide
KPANDITSQLEINFGDLGRPGRGGR

SEQ ID NO: 2538 - protein, 25 aa, Artificial Sequence
  Synthetic Peptide
KPANDITSQLEINFGDLGRPGRGGR

SEQ ID NO: 2539 - protein, 25 aa, Artificial Sequence
  Synthetic Peptide
KPANDITSQLEINFGDLGRPGRGGR

SEQ ID NO: 2540 - protein, 17 aa, Artificial Sequence
  Synthetic Peptide
MISTMRPDIDNMDEYVR

SEQ ID NO: 2541 - protein, 9 aa, Artificial Sequence
  Synthetic Peptide
RGGADVNIR

SEQ ID NO: 2542 - protein, 29 aa, Artificial Sequence
  Synthetic Peptide
KAVQGGAAAPVVGAVQPVPGMPPMPQAPR

SEQ ID NO: 2543 - protein, 40 aa, Artificial Sequence
  Synthetic Peptide
GVGGPSQQVMTPQGRGTVAAAAVAATASIAGAPTQYPPGR

SEQ ID NO: 2544 - protein, 27 aa, Artificial Sequence
  Synthetic Peptide
IALALTAISLGTARPPPSMSAAGLAAR

SEQ ID NO: 2545 - protein, 27 aa, Artificial Sequence
  Synthetic Peptide
TAVAPSAVNLADPRTPAASAVNLAGAR

SEQ ID NO: 2546 - protein, 15 aa, Artificial Sequence
  Synthetic Peptide
TPQAPTPANLVVGPR

SEQ ID NO: 2547 - protein, 22 aa, Artificial Sequence
  Synthetic Peptide
MAPALSGANLTSPRVPLSAYDR

SEQ ID NO: 2548 - protein, 22 aa, Artificial Sequence
  Synthetic Peptide
MAPALSGANLTSPRVPLSAYDR

SEQ ID NO: 2549 - protein, 14 aa, Artificial Sequence
  Synthetic Peptide
RGDDWNDREWDRGR

SEQ ID NO: 2550 - protein, 24 aa, Artificial Sequence
  Synthetic Peptide
RGGPPFAFVEFEDPRDAEDAVYGR

SEQ ID NO: 2551 - protein, 8 aa, Artificial Sequence
  Synthetic Peptide
YSDRFSSR

SEQ ID NO: 2552 - protein, 10 aa, Artificial Sequence
  Synthetic Peptide
TYGGRGGWPR

SEQ ID NO: 2553 - protein, 12 aa, Artificial Sequence
  Synthetic Peptide
GYGGSQGGGRGR

SEQ ID NO: 2554 - protein, 12 aa, Artificial Sequence
  Synthetic Peptide
GYGGSQGGGRGR

SEQ ID NO: 2555 - protein, 10 aa, Artificial Sequence
  Synthetic Peptide
GRGGYDKDGR

SEQ ID NO: 2556 - protein, 18 aa, Artificial Sequence
  Synthetic Peptide
FGGNPGGFGNQGGFGNSR

SEQ ID NO: 2557 - protein, 23 aa, Artificial Sequence
  Synthetic Peptide
EGNGGNAWDSGPPAGPGILAWGR

SEQ ID NO: 2558 - protein, 23 aa, Artificial Sequence
  Synthetic Peptide
QYEMGECTRGGFCNFMHLKPISR

SEQ ID NO: 2559 - protein, 12 aa, Artificial Sequence
  Synthetic Peptide
SVGAEPLLPWNR

SEQ ID NO: 2560 - protein, 14 aa, Artificial Sequence
  Synthetic Peptide
KYPLPPPSGRYSWN

SEQ ID NO: 2561 - protein, 12 aa, Artificial Sequence
  Synthetic Peptide
PFYAQADRCATR

SEQ ID NO: 2562 - protein, 12 aa, Artificial Sequence
  Synthetic Peptide
PFYAQADRCATR

SEQ ID NO: 2563 - protein, 9 aa, Artificial Sequence
  Synthetic Peptide
NQFNRGGGH

SEQ ID NO: 2564 - protein, 12 aa, Artificial Sequence
  Synthetic Peptide
GGAPGNRGGYNR

SEQ ID NO: 2565 - protein, 22 aa, Artificial Sequence
  Synthetic Peptide
EPPKVPQSAPFFIPTVPGLVPR

SEQ ID NO: 2566 - protein, 10 aa, Artificial Sequence
  Synthetic Peptide
PTFEPARGGR

SEQ ID NO: 2567 - protein, 20 aa, Artificial Sequence
  Synthetic Peptide
NLPLPPPPPPRGGDLMAYDR

SEQ ID NO: 2568 - protein, 20 aa, Artificial Sequence
  Synthetic Peptide
NLPLPPPPPPRGGDLMAYDR

SEQ ID NO: 2569 - protein, 9 aa, Artificial Sequence
  Synthetic Peptide
RGRPGDRYD

SEQ ID NO: 2570 - protein, 37 aa, Artificial Sequence
  Synthetic Peptide
AYEPQGGSGYDYSYAGGRGSYGDLGGPIITTQVTIPK

SEQ ID NO: 2571 - protein, 17 aa, Artificial Sequence
  Synthetic Peptide
NEVHTMLGQSTEEIRAR

SEQ ID NO: 2572 - protein, 25 aa, Artificial Sequence
  Synthetic Peptide
KADLCVDGCQSQGSLSFPLLERGRR

SEQ ID NO: 2573 - protein, 10 aa, Artificial Sequence
  Synthetic Peptide
YRRTDHEDPR

SEQ ID NO: 2574 - protein, 11 aa, Artificial Sequence
  Synthetic Peptide
GDIGRPGFGGR

SEQ ID NO: 2575 - protein, 30 aa, Artificial Sequence
  Synthetic Peptide
WQTPAEPCVLRQCQEGVVTESEVRCVVHCK

SEQ ID NO: 2576 - protein, 13 aa, Artificial Sequence
  Synthetic Peptide
VSATFISINRGLR

SEQ ID NO: 2577 - protein, 11 aa, Artificial Sequence
  Synthetic Peptide
DDLELLFLIAR

SEQ ID NO: 2578 - protein, 30 aa, Artificial Sequence
  Synthetic Peptide
TRADLSAVQSWVARHWLPAGCETAIFFPMR

SEQ ID NO: 2579 - protein, 31 aa, Artificial Sequence
  Synthetic Peptide
MHSLSYYLKYGGGEETTTGESENRREAADNQ

SEQ ID NO: 2580 - protein, 13 aa, Artificial Sequence
  Synthetic Peptide
IQFKPDDGTTPDR

SEQ ID NO: 2581 - protein, 15 aa, Artificial Sequence
  Synthetic Peptide
SVQAGNPGGPGPGGR

SEQ ID NO: 2582 - protein, 12 aa, Artificial Sequence
  Synthetic Peptide
NLQLLTENELHR

SEQ ID NO: 2583 - protein, 12 aa, Artificial Sequence
  Synthetic Peptide
GVPISSALTQSR

SEQ ID NO: 2584 - protein, 11 aa, Artificial Sequence
  Synthetic Peptide
FPTQISLAQLR

SEQ ID NO: 2585 - protein, 7 aa, Artificial Sequence
  Synthetic Peptide
LITFQLR

SEQ ID NO: 2586 - protein, 11 aa, Artificial Sequence
  Synthetic Peptide
MAGAMPARGGK

SEQ ID NO: 2587 - protein, 13 aa, Artificial Sequence
  Synthetic Peptide
MIAEEIMEIHRIR

SEQ ID NO: 2588 - protein, 15 aa, Artificial Sequence
  Synthetic Peptide
ERLADGEFTHEMQVR

SEQ ID NO: 2589 - protein, 13 aa, Artificial Sequence
  Synthetic Peptide
TCRPDISESPELR

SEQ ID NO: 2590 - protein, 13 aa, Artificial Sequence
  Synthetic Peptide
LVSELRWPIPGPR

SEQ ID NO: 2591 - protein, 31 aa, Artificial Sequence
  Synthetic Peptide
LTIPPPLGPETVAQSPLMNFLGDSNPFNLLR

SEQ ID NO: 2592 - protein, 22 aa, Artificial Sequence
  Synthetic Peptide
VLGIIPSTTGPSQQTFTSFQPR

SEQ ID NO: 2593 - protein, 15 aa, Artificial Sequence
  Synthetic Peptide
SGVLRGSNLGVTRTR

SEQ ID NO: 2594 - protein, 19 aa, Artificial Sequence
  Synthetic Peptide
GMAGSPSRGGIWQSSIVHY

SEQ ID NO: 2595 - protein, 17 aa, Artificial Sequence
  Synthetic Peptide
LQLGPRPPPVAVAVIPR

SEQ ID NO: 2596 - protein, 20 aa, Artificial Sequence
  Synthetic Peptide
DCDLQEDACYNCGRGGHIAK

SEQ ID NO: 2597 - protein, 42 aa, Artificial Sequence
  Synthetic Peptide
DMLASPSTSGQLSQFGASLYGQQSALGLPMRGMSNNTPQLNR

SEQ ID NO: 2598 - protein, 10 aa, Artificial Sequence
  Synthetic Peptide
HHGLVDRVYR

SEQ ID NO: 2599 - protein, 25 aa, Artificial Sequence
  Synthetic Peptide
GAEAANVTGPDGVPVEGSRYAADRR

SEQ ID NO: 2600 - protein, 26 aa, Artificial Sequence
  Synthetic Peptide
PAPAIGEAEDKENQQAANGPNQPSAR

SEQ ID NO: 2601 - protein, 11 aa, Artificial Sequence
  Synthetic Peptide
IWERGGGIAPR

SEQ ID NO: 2602 - protein, 8 aa, Artificial Sequence
  Synthetic Peptide
DRGGFGAR

SEQ ID NO: 2603 - protein, 9 aa, Artificial Sequence
  Synthetic Peptide
MRGGGFGDR

SEQ ID NO: 2604 - protein, 14 aa, Artificial Sequence
  Synthetic Peptide
GGFGARGGSGLPPK

SEQ ID NO: 2605 - protein, 14 aa, Artificial Sequence
  Synthetic Peptide
SSQSSSQQFSGIGR

SEQ ID NO: 2606 - protein, 11 aa, Artificial Sequence
  Synthetic Peptide
SRGRGGMKDDR

SEQ ID NO: 2607 - protein, 9 aa, Artificial Sequence
  Synthetic Peptide
GRGGMKDDR

SEQ ID NO: 2608 - protein, 26 aa, Artificial Sequence
  Synthetic Peptide
PGESTTSFPQPGQRGGGPQPQFPGQR

SEQ ID NO: 2609 - protein, 11 aa, Artificial Sequence
  Synthetic Peptide
GLSPSYLGGPR

SEQ ID NO: 2610 - protein, 11 aa, Artificial Sequence
  Synthetic Peptide
EGPAAPAAAAR

SEQ ID NO: 2611 - protein, 19 aa, Artificial Sequence
  Synthetic Peptide
AAAARGGPGAAPRGGAAAR

SEQ ID NO: 2612 - protein, 14 aa, Artificial Sequence
  Synthetic Peptide
GGPGAAPRGGAAAR

SEQ ID NO: 2613 - protein, 14 aa, Artificial Sequence
  Synthetic Peptide
GGPGAAPRGGAAAR

SEQ ID NO: 2614 - protein, 19 aa, Artificial Sequence
  Synthetic Peptide
SNLTGSGSINIVGTPLAVR

SEQ ID NO: 2615 - protein, 15 aa, Artificial Sequence
  Synthetic Peptide
GGPGGPGGPGGPMGR

SEQ ID NO: 2616 - protein, 21 aa, Artificial Sequence
  Synthetic Peptide
GAPALQLPQQCTFRFPSTAIK

SEQ ID NO: 2617 - protein, 15 aa, Artificial Sequence
  Synthetic Peptide
IFTIRGAPQQMEVAR

SEQ ID NO: 2618 - protein, 40 aa, Artificial Sequence
  Synthetic Peptide
VGGASLGAPAAFGQSPFSQPPAAPHQNTFPPRGFPNIAAK

SEQ ID NO: 2619 - protein, 8 aa, Artificial Sequence
  Synthetic Peptide
SSGGYEPR

SEQ ID NO: 2620 - protein, 25 aa, Artificial Sequence
  Synthetic Peptide
GGGGSGGGGRGGFPSGGGGGGGQQR

SEQ ID NO: 2621 - protein, 25 aa, Artificial Sequence
  Synthetic Peptide
APKPDGPGGGPGGSHMGGNYGDDRR

SEQ ID NO: 2622 - protein, 25 aa, Artificial Sequence
  Synthetic Peptide
APKPDGPGGGPGGSHMGGNYGDDRR

SEQ ID NO: 2623 - protein, 12 aa, Artificial Sequence
  Synthetic Peptide
GGGDRGGFGPGK

SEQ ID NO: 2624 - protein, 6 aa, Artificial Sequence
  Synthetic Peptide
VSFATR

SEQ ID NO: 2625 - protein, 20 aa, Artificial Sequence
  Synthetic Peptide
IPGSIIPPPLVRGGQQVSAK

SEQ ID NO: 2626 - protein, 16 aa, Artificial Sequence
  Synthetic Peptide
LGPQASSQVVMPPLVR

SEQ ID NO: 2627 - protein, 23 aa, Artificial Sequence
  Synthetic Peptide
VWNNGSSLQASSQLSRGSATAPR

SEQ ID NO: 2628 - protein, 30 aa, Artificial Sequence
  Synthetic Peptide
YHYDPSPIPPLHVPSALSSSPTYPDLPFIR

SEQ ID NO: 2629 - protein, 13 aa, Artificial Sequence
  Synthetic Peptide
APVTVTSLPASVR

SEQ ID NO: 2630 - protein, 11 aa, Artificial Sequence
  Synthetic Peptide
GAPGQPGTILR

SEQ ID NO: 2631 - protein, 19 aa, Artificial Sequence
  Synthetic Peptide
YCHLRGGGSGGGGYAPYGR

SEQ ID NO: 2632 - protein, 12 aa, Artificial Sequence
  Synthetic Peptide
FGSRGGPGGGFR

SEQ ID NO: 2633 - protein, 31 aa, Artificial Sequence
  Synthetic Peptide
FGSRGGPGGGFRPFVPHIPFDFYLCEMAFPR

SEQ ID NO: 2634 - protein, 31 aa, Artificial Sequence; identical to SEQ ID NO: 2633
  Synthetic Peptide

SEQ ID NO: 2635 - protein, 22 aa, Artificial Sequence
  Synthetic Peptide
MAEVVSPVPGAGRREPGEVGRA

SEQ ID NO: 2636 - protein, 8 aa, Artificial Sequence
  Synthetic Peptide
PVAVGVPR

SEQ ID NO: 2637 - protein, 10 aa, Artificial Sequence
  Synthetic Peptide
AGSVGGFFPR

SEQ ID NO: 2638 - protein, 19 aa, Artificial Sequence
  Synthetic Peptide
AVLTSGPSAPGSRKPPARR

SEQ ID NO: 2639 - protein, 11 aa, Artificial Sequence
  Synthetic Peptide
FGFSQDSGRGK

SEQ ID NO: 2640 - protein, 23 aa, Artificial Sequence
  Synthetic Peptide
VGDTSLDPNDFDFTVTGRGSPSR

SEQ ID NO: 2641 - protein, 17 aa, Artificial Sequence
  Synthetic Peptide
RGGGGTDLGPPAPPRPR

SEQ ID NO: 2642 - protein, 15 aa, Artificial Sequence
  Synthetic Peptide
MGELYRGAMTSSMER

SEQ ID NO: 2643 - protein, 19 aa, Artificial Sequence
  Synthetic Peptide
DFGRGDIGLSRGFGDSFGR

SEQ ID NO: 2644 - protein, 15 aa, Artificial Sequence
  Synthetic Peptide
GDIGLSRGFGDSFGR

SEQ ID NO: 2645 - protein, 23 aa, Artificial Sequence
  Synthetic Peptide
GVTGVDLYRGHIPLAFDPTSIPR

SEQ ID NO: 2646 - protein, 14 aa, Artificial Sequence
  Synthetic Peptide
GHIPLAFDPTSIPR

SEQ ID NO: 2647 - protein, 10 aa, Artificial Sequence
  Synthetic Peptide
ADMLRGLSPR

SEQ ID NO: 2648 - protein, 15 aa, Artificial Sequence
  Synthetic Peptide
GVVTSVEPGTPTVLR

SEQ ID NO: 2649 - protein, 22 aa, Artificial Sequence
  Synthetic Peptide
NSASGPGWYGANPDPRFPAISR

SEQ ID NO: 2650 - protein, 16 aa, Artificial Sequence
  Synthetic Peptide
GSYRGGSISVQVNSVK

SEQ ID NO: 2651 - protein, 10 aa, Artificial Sequence
  Synthetic Peptide
GRGSVMDLYK

SEQ ID NO: 2652 - protein, 15 aa, Artificial Sequence
  Synthetic Peptide
REEQLREKRAGLPDR

SEQ ID NO: 2653 - protein, 12 aa, Artificial Sequence
  Synthetic Peptide
GYEGSAFRGGFR

SEQ ID NO: 2654 - protein, 20 aa, Artificial Sequence
  Synthetic Peptide
TPIYLQPDTYSSLDRAPSPR

SEQ ID NO: 2655 - protein, 22 aa, Artificial Sequence
  Synthetic Peptide
TPIYLQPDTYSSLDRAPSPRPR

SEQ ID NO: 2656 - protein, 22 aa, Artificial Sequence
  Synthetic Peptide
TPIYLQPDTYSSLDRAPSPRPR

SEQ ID NO: 2657 - protein, 22 aa, Artificial Sequence
  Synthetic Peptide
TPIYLQPDTYSSLDRAPSPRPR

SEQ ID NO: 2658 - protein, 25 aa, Artificial Sequence
  Synthetic Peptide
APSPRPGIGPVRQPGPSTPFDYLGR

SEQ ID NO: 2659 - protein, 34 aa, Artificial Sequence
  Synthetic Peptide
GPSPRPPAAAYDTAGTFGSPLLGAGGSAFTPPLR

SEQ ID NO: 2660 - protein, 42 aa, Artificial Sequence
  Synthetic Peptide
GPSPRPPAAAYDTAGTFGSPLLGAGGSAFTPPLRAQDDSTLR

SEQ ID NO: 2661 - protein, 25 aa, Artificial Sequence
  Synthetic Peptide
QTTADWWWGERAGCCGYIPANHLGK

SEQ ID NO: 2662 - protein, 9 aa, Artificial Sequence
  Synthetic Peptide
INHEGEVNR

SEQ ID NO: 2663 - protein, 21 aa, Artificial Sequence
  Synthetic Peptide
MAEGGQAQQQPPQLGPGAAAR

SEQ ID NO: 2664 - protein, 30 aa, Artificial Sequence
  Synthetic Peptide
GGINTYIPLIIPGFPYPTAATTAAAFRGAH

SEQ ID NO: 2665 - protein, 32 aa, Artificial Sequence; identical to SEQ ID NO: 1631
  Synthetic Peptide

SEQ ID NO: 2666 - protein, 32 aa, Artificial Sequence; identical to SEQ ID NO: 1631
  Synthetic Peptide

SEQ ID NO: 2667 - protein, 34 aa, Artificial Sequence
  Synthetic Peptide
GGINTYIPLISLPLVPGFPYPTAATTAAAFRGAH

SEQ ID NO: 2668 - protein, 36 aa, Artificial Sequence
  Synthetic Peptide
GGINTYIPLISLPLVPGFPYPTAATTAAAFRGAHLR

SEQ ID NO: 2669 - protein, 36 aa, Artificial Sequence; identical to SEQ ID NO: 2668
  Synthetic Peptide

SEQ ID NO: 2670 - protein, 31 aa, Artificial Sequence
  Synthetic Peptide
VYTADPYHALAPAASYGVGAVASLYRGGYSR

SEQ ID NO: 2671 - protein, 31 aa, Artificial Sequence; identical to SEQ ID NO: 2670
  Synthetic Peptide

SEQ ID NO: 2672 - protein, 31 aa, Artificial Sequence; identical to SEQ ID NO: 2670
  Synthetic Peptide

SEQ ID NO: 2673 - protein, 18 aa, Artificial Sequence
  Synthetic Peptide
SQAPNNTVTYESERGGFR

SEQ ID NO: 2674 - protein, 13 aa, Artificial Sequence
  Synthetic Peptide
RLSEGRGLPPPPR

SEQ ID NO: 2675 - protein, 12 aa, Artificial Sequence
  Synthetic Peptide
LSEGRGLPPPPR

SEQ ID NO: 2676 - protein, 6 aa, Artificial Sequence
  Synthetic Peptide
GHVIPR

SEQ ID NO: 2677 - protein, 39 aa, Artificial Sequence
  Synthetic Peptide
GLAGGPGHGHVAAGRGGMAGQGSFAHGGHSQGYIVPSGR

SEQ ID NO: 2678 - protein, 31 aa, Artificial Sequence
  Synthetic Peptide
MPGGPKPGGGPGMGAPGGHPKPPHRGGGEPR

SEQ ID NO: 2679 - protein, 31 aa, Artificial Sequence; identical to SEQ ID NO: 2678
  Synthetic Peptide

SEQ ID NO: 2680 - protein, 34 aa, Artificial Sequence
  Synthetic Peptide
MPGGPKPGGGPGMGAPGGHPKPPHRGGGEPRGGR

SEQ ID NO: 2681 - protein, 12 aa, Artificial Sequence
  Synthetic Peptide
GMGPGTPAGYGR

SEQ ID NO: 2682 - protein, 29 aa, Artificial Sequence
  Synthetic Peptide
FGQGGAGPVGGQGPRGMGPGTPAGYGRGR

SEQ ID NO: 2683 - protein, 12 aa, Artificial Sequence
  Synthetic Peptide
EEYEGPNKKPRF

SEQ ID NO: 2684 - protein, 11 aa, Artificial Sequence
  Synthetic Peptide
SRGGGGGGFHR

SEQ ID NO: 2685 - protein, 21 aa, Artificial Sequence
  Synthetic Peptide
IVQMSGNSLPRGSSSGFKPFK

SEQ ID NO: 2686 - protein, 8 aa, Artificial Sequence
  Synthetic Peptide
GRGQFHGR

SEQ ID NO: 2687 - protein, 9 aa, Artificial Sequence
  Synthetic Peptide
GRGQFHGRR

SEQ ID NO: 2688 - protein, 15 aa, Artificial Sequence
  Synthetic Peptide
ASVHSSGRGSNRGSR

SEQ ID NO: 2689 - protein, 16 aa, Artificial Sequence
  Synthetic Peptide
VPGSIALPVQTLVSAR

SEQ ID NO: 2690 - protein, 11 aa, Artificial Sequence
  Synthetic Peptide
YCLTAPNYRLK

SEQ ID NO: 2691 - protein, 13 aa, Artificial Sequence
  Synthetic Peptide
DLKGRDAVAAEAR

SEQ ID NO: 2692 - protein, 12 aa, Artificial Sequence
  Synthetic Peptide
DAQDALVPRGPR

SEQ ID NO: 2693 - protein, 9 aa, Artificial Sequence
  Synthetic Peptide
MGGFHWVPR

SEQ ID NO: 2694 - protein, 9 aa, Artificial Sequence
  Synthetic Peptide
DAQDALVPR

SEQ ID NO: 2695 - protein, 12 aa, Artificial Sequence
  Synthetic Peptide
DAQDALVPRGQR

SEQ ID NO: 2696 - protein, 12 aa, Artificial Sequence
  Synthetic Peptide
DAQDALVPRGQR

SEQ ID NO: 2697 - protein, 12 aa, Artificial Sequence
  Synthetic Peptide
DAQDALVPRGQR

SEQ ID NO: 2698 - protein, 7 aa, Artificial Sequence
  Synthetic Peptide
FNPGELR

SEQ ID NO: 2699 - protein, 9 aa, Artificial Sequence
  Synthetic Peptide
GGGPRSLSR

SEQ ID NO: 2700 - protein, 37 aa, Artificial Sequence
  Synthetic Peptide
ALASIYSPDHSSNNFSPSPSTPVGSPQGLPGTSQWPR

SEQ ID NO: 2701 - protein, 16 aa, Artificial Sequence
  Synthetic Peptide
AAYQAAIRGVGSAQSR

SEQ ID NO: 2702 - protein, 15 aa, Artificial Sequence
  Synthetic Peptide
GGGTEEASEGGRGGR

SEQ ID NO: 2703 - protein, 29 aa, Artificial Sequence
  Synthetic Peptide
LSAVEAIANAISVVSSNGPGNRAGSSNSR

SEQ ID NO: 2704 - protein, 23 aa, Artificial Sequence
  Synthetic Peptide
PGFIAPAYFPVFPDRHLTPEVYR

SEQ ID NO: 2705 - protein, 23 aa, Artificial Sequence
  Synthetic Peptide
PGFIAPAYFPVFPDRHLTPEVYR

SEQ ID NO: 2706 - protein, 9 aa, Artificial Sequence
  Synthetic Peptide
RFPPYYMRR

SEQ ID NO: 2707 - protein, 10 aa, Artificial Sequence
  Synthetic Peptide
QNMYRGYRPR

SEQ ID NO: 2708 - protein, 13 aa, Artificial Sequence
  Synthetic Peptide
ERGLGRPDFGHDR

SEQ ID NO: 2709 - protein, 8 aa, Artificial Sequence
  Synthetic Peptide
GPRFDGPR

SEQ ID NO: 2710 - protein, 17 aa, Artificial Sequence
  Synthetic Peptide
WGTIPRGPASQFYITPN

SEQ ID NO: 2711 - protein, 12 aa, Artificial Sequence
  Synthetic Peptide
HLRGHGPQPPLR

SEQ ID NO: 2712 - protein, 20 aa, Artificial Sequence
  Synthetic Peptide
YDVRRVYLGEAHGPWVDLRR

SEQ ID NO: 2713 - protein, 18 aa, Artificial Sequence
  Synthetic Peptide
HGLPLGTQSSGRGGSLAR

SEQ ID NO: 2714 - protein, 15 aa, Artificial Sequence
  Synthetic Peptide
SLRGGPGSGGHGPLR

SEQ ID NO: 2715 - protein, 30 aa, Artificial Sequence
  Synthetic Peptide
SHLSTAGGLAVPSLPTAGPYYSPYALYGQR

SEQ ID NO: 2716 - protein, 33 aa, Artificial Sequence
  Synthetic Peptide
ESRESTTLDSHSAEDQMELLVIKVEQEEASPLA

SEQ ID NO: 2717 - protein, 38 aa, Artificial Sequence
  Synthetic Peptide
SYVQQGVYGRGSYPGGSSFTTGYAGGPAGLGLPTHAAR

SEQ ID NO: 2718 - protein, 39 aa, Artificial Sequence
  Synthetic Peptide
SSGGGRGGGAGGGGGGSGGGGGGGGGGGGGGGGGGSRGG

SEQ ID NO: 2719 - protein, 8 aa, Artificial Sequence
  Synthetic Peptide
RLPNVHSK

SEQ ID NO: 2720 - protein, 29 aa, Artificial Sequence
  Synthetic Peptide
AGRGETTKPEEGTERPEPIQPVTLNLSFK

SEQ ID NO: 2721 - protein, 29 aa, Artificial Sequence
  Synthetic Peptide
AGRGETTKPEEGTERPEPIQPVTLNLSFK

SEQ ID NO: 2722 - protein, 33 aa, Artificial Sequence
  Synthetic Peptide
RGGGGSGGGGTQGAEEEPPPPLQAVLVADSFNR

SEQ ID NO: 2723 - protein, 9 aa, Artificial Sequence
  Synthetic Peptide
DRYDDRGSR

SEQ ID NO: 2724 - protein, 14 aa, Artificial Sequence
  Synthetic Peptide
DDDYRGGGDRYEDR

SEQ ID NO: 2725 - protein, 14 aa, Artificial Sequence
  Synthetic Peptide
APPIDRSILPTAPR

SEQ ID NO: 2726 - protein, 14 aa, Artificial Sequence
  Synthetic Peptide
LLFQNLWKPRLNVP

SEQ ID NO: 2727 - protein, 11 aa, Artificial Sequence
  Synthetic Peptide
RGGPPGPPINR

SEQ ID NO: 2728 - protein, 28 aa, Artificial Sequence
  Synthetic Peptide
RGGPPGPPINRGLPLVDDGGWNTVPISK

SEQ ID NO: 2729 - protein, 19 aa, Artificial Sequence
  Synthetic Peptide
SLQHFYPSRAQPPSSAASR

SEQ ID NO: 2730 - protein, 22 aa, Artificial Sequence
  Synthetic Peptide
MIPSQISYSASQGAYYIPGQGR

SEQ ID NO: 2731 - protein, 13 aa, Artificial Sequence
  Synthetic Peptide
GPPRGGPGGELPR

SEQ ID NO: 2732 - protein, 21 aa, Artificial Sequence
  Synthetic Peptide
GPPRGGPGGELPRGPAGLGPR

SEQ ID NO: 2733 - protein, 16 aa, Artificial Sequence
  Synthetic Peptide
QTPGGRGVPLLNVGPR

SEQ ID NO: 2734 - protein, 13 aa, Artificial Sequence
  Synthetic Peptide
KGGPDDRGMGGSR

SEQ ID NO: 2735 - protein, 13 aa, Artificial Sequence
  Synthetic Peptide
KGGPDDRGMGGSR

SEQ ID NO: 2736 - protein, 9 aa, Artificial Sequence
  Synthetic Peptide
ESRGGWDSR

SEQ ID NO: 2737 - protein, 9 aa, Artificial Sequence
  Synthetic Peptide
RAGPPMGSR

SEQ ID NO: 2738 - protein, 13 aa, Artificial Sequence
  Synthetic Peptide
DGPPLRGSNMDFR

SEQ ID NO: 2739 - protein, 12 aa, Artificial Sequence
  Synthetic Peptide
GSRGSAGGHGSR

SEQ ID NO: 2740 - protein, 21 aa, Artificial Sequence
  Synthetic Peptide
AYSSFGGGRGSRGSAGGHGSR

SEQ ID NO: 2741 - protein, 15 aa, Artificial Sequence
  Synthetic Peptide
GYVTDDGQGMGRGSR

SEQ ID NO: 2742 - protein, 18 aa, Artificial Sequence
  Synthetic Peptide
GYVTDDGQGMGRGSRPYR

SEQ ID NO: 2743 - protein, 18 aa, Artificial Sequence
  Synthetic Peptide
GYVTDDGQGMGRGSRPYR

SEQ ID NO: 2744 - protein, 11 aa, Artificial Sequence
  Synthetic Peptide
SRGQNRPTNVK

SEQ ID NO: 2745 - protein, 12 aa, Artificial Sequence
  Synthetic Peptide
KLNTETFGVSGR

SEQ ID NO: 2746 - protein, 12 aa, Artificial Sequence
  Synthetic Peptide
RNPTSHRAGTGR

SEQ ID NO: 2747 - protein, 13 aa, Artificial Sequence
  Synthetic Peptide
AIRGGTASMCVFR

SEQ ID NO: 2748 - protein, 14 aa, Artificial Sequence
  Synthetic Peptide
SGQGAFGNMCRGGR

SEQ ID NO: 2749 - protein, 14 aa, Artificial Sequence
  Synthetic Peptide
SGQGAFGNMCRGGR

SEQ ID NO: 2750 - protein, 14 aa, Artificial Sequence
  Synthetic Peptide
AEAGAGSATEFQFR

SEQ ID NO: 2751 - protein, 12 aa, Artificial Sequence
  Synthetic Peptide
CPFTGNVSIRGR

SEQ ID NO: 2752 - protein, 12 aa, Artificial Sequence
  Synthetic Peptide
CPFTGNVSIRGR

SEQ ID NO: 2753 - protein, 15 aa, Artificial Sequence
  Synthetic Peptide
HLYLRGGAGVGSMTK

SEQ ID NO: 2754 - protein, 12 aa, Artificial Sequence
  Synthetic Peptide
GHQQLYWSHPRK

SEQ ID NO: 2755 - protein, 24 aa, Artificial Sequence
  Synthetic Peptide
FAHSSPLERGGIHSNLCSSPLNSR

SEQ ID NO: 2756 - protein, 21 aa, Artificial Sequence
  Synthetic Peptide
HAMFLPSAHPIPFCPIPVYPR

SEQ ID NO: 2757 - protein, 36 aa, Artificial Sequence
  Synthetic Peptide
AYLPTSLLPPGIIGGEYDERPILPSVGDPVTSLIPR

SEQ ID NO: 2758 - protein, 17 aa, Artificial Sequence
  Synthetic Peptide
FDPVDPLPGPHSLLPGR

SEQ ID NO: 2759 - protein, 18 aa, Artificial Sequence
  Synthetic Peptide
HNPQSPLQESSATLKRGG

SEQ ID NO: 2760 - protein, 30 aa, Artificial Sequence
  Synthetic Peptide
LAVQRGGTFQMGGSSSHNRPSGSNVDTLLR

SEQ ID NO: 2761 - protein, 18 aa, Artificial Sequence
  Synthetic Peptide
GSQLYPAQQADVYYQDPR

SEQ ID NO: 2762 - protein, 26 aa, Artificial Sequence
  Synthetic Peptide
CASDIFQASNPYLPTRGGTTVASGGR

SEQ ID NO: 2763 - protein, 26 aa, Artificial Sequence
  Synthetic Peptide
CASDIFQASNPYLPTRGGTTVASGGR

SEQ ID NO: 2764 - protein, 17 aa, Artificial Sequence
  Synthetic Peptide
NYFSGSRGSVQGMFAPR

SEQ ID NO: 2765 - protein, 20 aa, Artificial Sequence
  Synthetic Peptide
CSNDSFSVIADYFGRGVFNK

SEQ ID NO: 2766 - protein, 38 aa, Artificial Sequence
  Synthetic Peptide
PLGPLPCPIPQEDFPALGGPCPPRMPPPPGFSTVVLLK

SEQ ID NO: 2767 - protein, 12 aa, Artificial Sequence
  Synthetic Peptide
ITLTSDPRLPYK

SEQ ID NO: 2768 - protein, 43 aa, Artificial Sequence
  Synthetic Peptide
TGALRGAALGPPVSLPAPLTEAAPPAPPARPPPGPGPTPAPAK

SEQ ID NO: 2769 - protein, 10 aa, Artificial Sequence
  Synthetic Peptide
VGSEGTMTAR

SEQ ID NO: 2770 - protein, 15 aa, Artificial Sequence
  Synthetic Peptide
SGGARGSFAPGHGPR

SEQ ID NO: 2771 - protein, 17 aa, Artificial Sequence
  Synthetic Peptide
RPGASSGGRGGGGGSDR

SEQ ID NO: 2772 - protein, 8 aa, Artificial Sequence
  Synthetic Peptide
EGITRGGK

SEQ ID NO: 2773 - protein, 16 aa, Artificial Sequence
  Synthetic Peptide
VLQRSEELRSTSDSCR

SEQ ID NO: 2774 - protein, 9 aa, Artificial Sequence
  Synthetic Peptide
GVQTLVIGR

SEQ ID NO: 2775 - protein, 16 aa, Artificial Sequence
  Synthetic Peptide
GLLAAVPGLGPHATCR

SEQ ID NO: 2776 - protein, 20 aa, Artificial Sequence
  Synthetic Peptide
GLLAAVPGLGPHATCRGGSR

SEQ ID NO: 2777 - protein, 16 aa, Artificial Sequence
  Synthetic Peptide
DEQSHVGAAPALRGSR

SEQ ID NO: 2778 - protein, 12 aa, Artificial Sequence
  Synthetic Peptide
LALGSRGGYNGR

SEQ ID NO: 2779 - protein, 14 aa, Artificial Sequence
  Synthetic Peptide
RPLRGGWAPTSWGR

SEQ ID NO: 2780 - protein, 30 aa, Artificial Sequence; identical to SEQ ID NO: 1651
  Synthetic Peptide

SEQ ID NO: 2781 - protein, 27 aa, Artificial Sequence
  Synthetic Peptide
PLNCGVYGFPSLSYGSRYCSPIYFASR

SEQ ID NO: 2782 - protein, 20 aa, Artificial Sequence
  Synthetic Peptide
TAAGSRGGSAAWDAVAVAPR

SEQ ID NO: 2783 - protein, 19 aa, Artificial Sequence
  Synthetic Peptide
GGSAAWDAVAVAPRLPQPR

SEQ ID NO: 2784 - protein, 19 aa, Artificial Sequence
  Synthetic Peptide
GGSAAWDAVAVAPRLPQPR

SEQ ID NO: 2785 - protein, 13 aa, Artificial Sequence
  Synthetic Peptide
EAASAPTTGGRGK

SEQ ID NO: 2786 - protein, 16 aa, Artificial Sequence
  Synthetic Peptide
SGGGRGGPGPAVTSAR

SEQ ID NO: 2787 - protein, 18 aa, Artificial Sequence
  Synthetic Peptide
SGGGRGGPGPAVTSARGR

SEQ ID NO: 2788 - protein, 21 aa, Artificial Sequence
  Synthetic Peptide
ESIYHIMATQPGASALPRGGK

SEQ ID NO: 2789 - protein, 9 aa, Artificial Sequence
  Synthetic Peptide
SLVSMFCGR

SEQ ID NO: 2790 - protein, 8 aa, Artificial Sequence
  Synthetic Peptide
RSNLSFGR

SEQ ID NO: 2791 - protein, 29 aa, Artificial Sequence
  Synthetic Peptide
ITGDLDAGAQEEEPVYIEMVGDVFRGGGR

SEQ ID NO: 2792 - protein, 16 aa, Artificial Sequence
  Synthetic Peptide
CAHPRGGVIQSVSSWK

SEQ ID NO: 2793 - protein, 21 aa, Artificial Sequence
  Synthetic Peptide
RGGQSGRPSMTSTIGSNAQGK

SEQ ID NO: 2794 - protein, 11 aa, Artificial Sequence
  Synthetic Peptide
SRAGGPGPAGR

SEQ ID NO: 2795 - protein, 17 aa, Artificial Sequence
  Synthetic Peptide
NLVGALDEDDGDSPAAR

SEQ ID NO: 2796 - protein, 20 aa, Artificial Sequence
  Synthetic Peptide
ESTPQSGICAAAAGRGHSAR

SEQ ID NO: 2797 - protein, 15 aa, Artificial Sequence
  Synthetic Peptide
RPPTPGPDVPITGPR

SEQ ID NO: 2798 - protein, 6 aa, Artificial Sequence
  Synthetic Peptide
IALGSR

SEQ ID NO: 2799 - protein, 12 aa, Artificial Sequence
  Synthetic Peptide
GRGAAAAGGPQR

SEQ ID NO: 2800 - protein, 25 aa, Artificial Sequence
  Synthetic Peptide
RLQKKKPRQDEMMGVPSPGHGVQEK

SEQ ID NO: 2801 - protein, 12 aa, Artificial Sequence
  Synthetic Peptide
RNFSSNMPIMQR

SEQ ID NO: 2802 - protein, 11 aa, Artificial Sequence
  Synthetic Peptide
IPPAGERGGHK

SEQ ID NO: 2803 - protein, 13 aa, Artificial Sequence
  Synthetic Peptide
QLQGKVEELTEER

SEQ ID NO: 2804 - protein, 27 aa, Artificial Sequence
  Synthetic Peptide
AGVGRASQGWEDGAGEQLRGGPGGRGR

SEQ ID NO: 2805 - protein, 22 aa, Artificial Sequence
  Synthetic Peptide
ASQGWEDGAGEQLRGGPGGRGR

SEQ ID NO: 2806 - protein, 19 aa, Artificial Sequence
  Synthetic Peptide
GSGDSSTSTSTSRGGCGGR

SEQ ID NO: 2807 - protein, 13 aa, Artificial Sequence
  Synthetic Peptide
TVYHAEEVQCDGR

SEQ ID NO: 2808 - protein, 25 aa, Artificial Sequence
  Synthetic Peptide
RGGDTGSGCGPGRPEGDSAPAATTR

SEQ ID NO: 2809 - protein, 11 aa, Artificial Sequence
  Synthetic Peptide
PLDGYISALLR

SEQ ID NO: 2810 - protein, 20 aa, Artificial Sequence
  Synthetic Peptide
YHSLGNISRGGSGGNSSNDK

SEQ ID NO: 2811 - protein, 26 aa, Artificial Sequence
  Synthetic Peptide
SDIQRLVCGAGNEELGAGALPCVSAR

SEQ ID NO: 2812 - protein, 23 aa, Artificial Sequence
  Synthetic Peptide
PTEGELHDFIAEIEEEEPTGYIR

SEQ ID NO: 2813 - protein, 16 aa, Artificial Sequence
  Synthetic Peptide
GGGSWGPGRGGAGGLR

SEQ ID NO: 2814 - protein, 21 aa, Artificial Sequence
  Synthetic Peptide
ITRGSAPLPPPPLPPAAFGAY

SEQ ID NO: 2815 - protein, 16 aa, Artificial Sequence
  Synthetic Peptide
SRGFAGLHPIPPQGGK

SEQ ID NO: 2816 - protein, 17 aa, Artificial Sequence
  Synthetic Peptide
SRGSFGMQVVSVGGPGK

SEQ ID NO: 2817 - protein, 12 aa, Artificial Sequence
  Synthetic Peptide
VSNRGLAGTTIR

SEQ ID NO: 2818 - protein, 32 aa, Artificial Sequence
  Synthetic Peptide
CRQPVPPTALPAHLQPSAQTQGPWPLASSGPR

SEQ ID NO: 2819 - protein, 32 aa, Artificial Sequence; identical to SEQ ID NO: 2818
  Synthetic Peptide

SEQ ID NO: 2820 - protein, 30 aa, Artificial Sequence
  Synthetic Peptide
QPVPPTALPAHLQPSAQTQGPWPLASSGPR

SEQ ID NO: 2821 - protein, 15 aa, Artificial Sequence
  Synthetic Peptide
RTPAQAAFEKMQEKR

SEQ ID NO: 2822 - protein, 20 aa, Artificial Sequence
  Synthetic Peptide
PTEAGPFGELAGPRGFFQSR

SEQ ID NO: 2823 - protein, 31 aa, Artificial Sequence
  Synthetic Peptide
VALAGGPCPPASGPASGPVSGPPVERPPLAT

SEQ ID NO: 2824 - protein, 25 aa, Artificial Sequence
  Synthetic Peptide
FLLASVGMTSLRAGGCRLVFHSSPR

SEQ ID NO: 2825 - protein, 27 aa, Artificial Sequence
  Synthetic Peptide
AGLTALQLAASRGHGTCVQALTGPWGR

SEQ ID NO: 2826 - protein, 20 aa, Artificial Sequence
  Synthetic Peptide
GSGLGARGSSYGVTSTESYK

SEQ ID NO: 2827 - protein, 26 aa, Artificial Sequence
  Synthetic Peptide
GTWLWVAPGRGAGAQPVLSVSAQNSR

SEQ ID NO: 2828 - protein, 14 aa, Artificial Sequence
  Synthetic Peptide
SEIRLPGALAFGQR

SEQ ID NO: 2829 - protein, 30 aa, Artificial Sequence
  Synthetic Peptide
AAPELETPLVAPATAVQAPLLPDHPATAAR

SEQ ID NO: 2830 - protein, 6 aa, Artificial Sequence
  Synthetic Peptide
IGILAR

SEQ ID NO: 2831 - protein, 22 aa, Artificial Sequence
  Synthetic Peptide
APGMRPPIGGHMPMIPGPPMMR

SEQ ID NO: 2832 - protein, 22 aa, Artificial Sequence
  Synthetic Peptide
CQPSCCCPTSSVSLLCRPACSR

SEQ ID NO: 2833 - protein, 14 aa, Artificial Sequence
  Synthetic Peptide
TAPQFHGLTVPGPR

SEQ ID NO: 2834 - protein, 11 aa, Artificial Sequence
  Synthetic Peptide
RGGSYYAGEVR

SEQ ID NO: 2835 - protein, 9 aa, Artificial Sequence
  Synthetic Peptide
AYGMPFVPR

SEQ ID NO: 2836 - protein, 12 aa, Artificial Sequence
  Synthetic Peptide
SWDNILAPGPRR

SEQ ID NO: 2837 - protein, 12 aa, Artificial Sequence
  Synthetic Peptide
SWDNILAPGPRR

SEQ ID NO: 2838 - protein, 20 aa, Artificial Sequence
  Synthetic Peptide
GRGVLFLGFPSPGSADNFLR

SEQ ID NO: 2839 - protein, 6 aa, Artificial Sequence
  Synthetic Peptide
GSILVR

SEQ ID NO: 2840 - protein, 13 aa, Artificial Sequence
  Synthetic Peptide
HFRPFCLVLRKRK

SEQ ID NO: 2841 - protein, 34 aa, Artificial Sequence
  Synthetic Peptide
QLGSSHGPEAASPVLKTWRLVHTGPLPQEMTLQR

SEQ ID NO: 2842 - protein, 8 aa, Artificial Sequence
  Synthetic Peptide
RSSVNLVK

SEQ ID NO: 2843 - protein, 14 aa, Artificial Sequence
  Synthetic Peptide
CYSWELQDRFAQDK

SEQ ID NO: 2844 - protein, 14 aa, Artificial Sequence
  Synthetic Peptide
RGTRGGNLVTGTQR

SEQ ID NO: 2845 - protein, 13 aa, Artificial Sequence
  Synthetic Peptide
GTRGGNLVTGTQR

SEQ ID NO: 2846 - protein, 14 aa, Artificial Sequence
  Synthetic Peptide
LQPGVGVGGRGTLR

SEQ ID NO: 2847 - protein, 10 aa, Artificial Sequence
  Synthetic Peptide
RNARMGAQRR

SEQ ID NO: 2848 - protein, 14 aa, Artificial Sequence
  Synthetic Peptide
GGFRGGFGSGIRGR

SEQ ID NO: 2849 - protein, 9 aa, Artificial Sequence
  Synthetic Peptide
RGGGLQGSR

SEQ ID NO: 2850 - protein, 26 aa, Artificial Sequence
  Synthetic Peptide
ALSQLGICSLEIRKPSPFDGGIYTCK

SEQ ID NO: 2851 - protein, 15 aa, Artificial Sequence
  Synthetic Peptide
GRGSTISEAECHHAR

SEQ ID NO: 2852 - protein, 8 aa, Artificial Sequence
  Synthetic Peptide
RGGHHQGY

SEQ ID NO: 2853 - protein, 15 aa, Artificial Sequence
  Synthetic Peptide
SDWGSSGRGGYQHVR

SEQ ID NO: 2854 - protein, 18 aa, Artificial Sequence
  Synthetic Peptide
WAAHGTSPEDFSLTLGAR

SEQ ID NO: 2855 - protein, 11 aa, Artificial Sequence
  Synthetic Peptide
GMRRSYDAGFK

SEQ ID NO: 2856 - protein, 27 aa, Artificial Sequence
  Synthetic Peptide
SSPYGRGWWGINAEPPFPGPGHGGPSR

SEQ ID NO: 2857 - protein, 19 aa, Artificial Sequence
  Synthetic Peptide
NNWIFIDEEQAFGGRGQAR

SEQ ID NO: 2858 - protein, 18 aa, Artificial Sequence
  Synthetic Peptide
PAGSSTSGLCGTGVLGSR

SEQ ID NO: 2859 - protein, 13 aa, Artificial Sequence
  Synthetic Peptide
TLGQQLNAELRGR

SEQ ID NO: 2860 - protein, 22 aa, Artificial Sequence
  Synthetic Peptide
GRGWGQQDGPGPPSPCPSPSPR

SEQ ID NO: 2861 - protein, 18 aa, Artificial Sequence
  Synthetic Peptide
STRGPRPDLETSPGAAAR

SEQ ID NO: 2862 - protein, 18 aa, Artificial Sequence
  Synthetic Peptide
SLGGLSGSRGGGGGGGGK

SEQ ID NO: 2863 - protein, 10 aa, Artificial Sequence
  Synthetic Peptide
LGSEVLGEWR

SEQ ID NO: 2864 - protein, 18 aa, Artificial Sequence
  Synthetic Peptide
SGLPRPSAPSAGGIPVPR

SEQ ID NO: 2865 - protein, 12 aa, Artificial Sequence
  Synthetic Peptide
LLTHNLLSSHVR

SEQ ID NO: 2866 - protein, 22 aa, Artificial Sequence
  Synthetic Peptide
VAACRGGQNLPTSCPASHSSPR

SEQ ID NO: 2867 - protein, 10 aa, Artificial Sequence
  Synthetic Peptide
AVTLSGGRGR

SEQ ID NO: 2868 - protein, 12 aa, Artificial Sequence
  Synthetic Peptide
FSALQVFGGAGR

SEQ ID NO: 2869 - protein, 10 aa, Artificial Sequence
  Synthetic Peptide
RGAAQWAAVR

SEQ ID NO: 2870 - protein, 11 aa, Artificial Sequence
  Synthetic Peptide
DFGDSLARGGK

SEQ ID NO: 2871 - protein, 22 aa, Artificial Sequence
  Synthetic Peptide
GFLRGVVGGVTGIITKPVEGAK

SEQ ID NO: 2872 - protein, 15 aa, Artificial Sequence
  Synthetic Peptide
SVSRGSYQLQAQMNR

SEQ ID NO: 2873 - protein, 17 aa, Artificial Sequence
  Synthetic Peptide
DLYLASNCPVAALEMRR

SEQ ID NO: 2874 - protein, 26 aa, Artificial Sequence
  Synthetic Peptide
GSSCGLPLMNSFNLKDMGPGLGSETR

SEQ ID NO: 2875 - protein, 32 aa, Artificial Sequence
  Synthetic Peptide
AVSCLNQASTTLHVNCSHCKRPMSSRGWVCDR

SEQ ID NO: 2876 - protein, 16 aa, Artificial Sequence
  Synthetic Peptide
SHKPEPPVAGPGRGGR

SEQ ID NO: 2877 - protein, 16 aa, Artificial Sequence
  Synthetic Peptide
SHKPEPPVAGPGRGGR

SEQ ID NO: 2878 - protein, 11 aa, Artificial Sequence
  Synthetic Peptide
YQAAVSRGDTR

SEQ ID NO: 2879 - protein, 24 aa, Artificial Sequence
  Synthetic Peptide
DVVTPLSTLLPPIPNSIPLRGQVK

SEQ ID NO: 2880 - protein, 37 aa, Artificial Sequence
  Synthetic Peptide
FFQQYHSNLPIPYGFYRPESAFPSYSLRLPSVTGITR

SEQ ID NO: 2881 - protein, 37 aa, Artificial Sequence; identical to SEQ ID NO: 2880
  Synthetic Peptide

SEQ ID NO: 2882 - protein, 28 aa, Artificial Sequence
  Synthetic Peptide
GSQSLHCGLCAVSCTGADAYAAHMRGAR

SEQ ID NO: 2883 - protein, 28 aa, Artificial Sequence
  Synthetic Peptide
GSQSLHCGLCAVSCTGADAYAAHMRGAR

SEQ ID NO: 2884 - protein, 13 aa, Artificial Sequence
  Synthetic Peptide
RMREASQAQEGTR

SEQ ID NO: 2885 - protein, 13 aa, Artificial Sequence
  Synthetic Peptide
RPPPPRPVAPPAR

SEQ ID NO: 2886 - protein, 39 aa, Artificial Sequence
  Synthetic Peptide
NQPSPQAGLAGPGPAGYGAARPTIPARAGVISAPQSQAR

SEQ ID NO: 2887 - protein, 18 aa, Artificial Sequence
  Synthetic Peptide
PTIPARAGVISAPQSQAR

SEQ ID NO: 2888 - protein, 39 aa, Artificial Sequence; identical to SEQ ID NO: 2886
  Synthetic Peptide

SEQ ID NO: 2889 - protein, 11 aa, Artificial Sequence
  Synthetic Peptide
ASGAPPGGQQR

SEQ ID NO: 2890 - protein, 15 aa, Artificial Sequence
  Synthetic Peptide
QGPPQKPPGPAGPTR

SEQ ID NO: 2891 - protein, 29 aa, Artificial Sequence
  Synthetic Peptide
QTTAAAAATFSEQVGGGSGGAGRGGAAAR

SEQ ID NO: 2892 - protein, 29 aa, Artificial Sequence
  Synthetic Peptide
QTTAAAAATFSEQVGGGSGGAGRGGAAAR

SEQ ID NO: 2893 - protein, 22 aa, Artificial Sequence
  Synthetic Peptide
DASPGRGSHSQSSSPGALTLGR

SEQ ID NO: 2894 - protein, 30 aa, Artificial Sequence
  Synthetic Peptide
QTSQQPAGPPAQQRPPPQGGPPQPGPGPQR

SEQ ID NO: 2895 - protein, 31 aa, Artificial Sequence
  Synthetic Peptide
QGPPLQQRPPPQGQQHLSGLGPPAGSPLPQR

SEQ ID NO: 2896 - protein, 25 aa, Artificial Sequence
  Synthetic Peptide
QSRPVAGGPGAPPAARPPASPSPQR

SEQ ID NO: 2897 - protein, 25 aa, Artificial Sequence
  Synthetic Peptide
QSRPVAGGPGAPPAARPPASPSPQR

SEQ ID NO: 2898 - protein, 22 aa, Artificial Sequence
  Synthetic Peptide
PVAGGPGAPPAARPPASPSPQR

SEQ ID NO: 2899 - protein, 22 aa, Artificial Sequence
  Synthetic Peptide
PVAGGPGAPPAARPPASPSPQR

SEQ ID NO: 2900 - protein, 31 aa, Artificial Sequence
  Synthetic Peptide
PVAGGPGAPPAARPPASPSPQRQAGAPQATR

SEQ ID NO: 2901 - protein, 10 aa, Artificial Sequence
  Synthetic Peptide
QASQAGPGPR

SEQ ID NO: 2902 - protein, 19 aa, Artificial Sequence
  Synthetic Peptide
TGPPTTQQPRPSGPGPAGR

SEQ ID NO: 2903 - protein, 14 aa, Artificial Sequence
  Synthetic Peptide
RGGGSGEAGAPCGR

SEQ ID NO: 2904 - protein, 8 aa, Artificial Sequence
  Synthetic Peptide
AYGRGQAR

SEQ ID NO: 2905 - protein, 35 aa, Artificial Sequence
  Synthetic Peptide
ASNPFLPSGAPPTGPSVTNPFQPAPPATLTLNQLR

SEQ ID NO: 2906 - protein, 20 aa, Artificial Sequence
  Synthetic Peptide
SAGGHPGSGPQLGTGRGTLR

SEQ ID NO: 2907 - protein, 15 aa, Artificial Sequence
  Synthetic Peptide
QAALSPALLSGLLPR

SEQ ID NO: 2908 - protein, 35 aa, Artificial Sequence
  Synthetic Peptide
MAQVATGVGSNQITFGRGSSQPNLSTSYSEQEYGK

SEQ ID NO: 2909 - protein, 19 aa, Artificial Sequence
  Synthetic Peptide
PGSRGGPLGTGGVLSSQIK

SEQ ID NO: 2910 - protein, 25 aa, Artificial Sequence
  Synthetic Peptide
RPPGQKPGPDLTSAPGRGSHGPPTR

SEQ ID NO: 2911 - protein, 27 aa, Artificial Sequence
  Synthetic Peptide
MRPPFGAAAVPGTQLSPSPTPATQSPK

SEQ ID NO: 2912 - protein, 15 aa, Artificial Sequence
  Synthetic Peptide
RKGHVITAISITHFK

SEQ ID NO: 2913 - protein, 35 aa, Artificial Sequence; identical to SEQ ID NO: 1687
  Synthetic Peptide

SEQ ID NO: 2914 - protein, 32 aa, Artificial Sequence
  Synthetic Peptide
KPQNLNDAYGPPSNFLEIDVSNPQTVGVGRGR

SEQ ID NO: 2915 - protein, 23 aa, Artificial Sequence
  Synthetic Peptide
GQGQLGPLLGQPQPRPPPQGGPR

SEQ ID NO: 2916 - protein, 13 aa, Artificial Sequence
  Synthetic Peptide
FEESKGRGFSIVT

SEQ ID NO: 2917 - protein, 13 aa, Artificial Sequence
  Synthetic Peptide
  misc_feature (11)..(13): Xaa can be any naturally occurring amino acid
TGYGMPRQIMXXX

SEQ ID NO: 2918 - protein, 13 aa, Artificial Sequence
  Synthetic Peptide
MNRPASRHTPPTI

SEQ ID NO: 2919 - protein, 13 aa, Artificial Sequence
  Synthetic Peptide
GLDLGGRGGVQVP

SEQ ID NO: 2920 - protein, 13 aa, Artificial Sequence
  Synthetic Peptide
DGFMRGRGQGRFQ

SEQ ID NO: 2921 - protein, 13 aa, Artificial Sequence
  Synthetic Peptide
RGRGQGRFQDRSN

SEQ ID NO: 2922 - protein, 13 aa, Artificial Sequence
  Synthetic Peptide
LNYVGGRGLGGPS

SEQ ID NO: 2923 - protein, 13 aa, Artificial Sequence
  Synthetic Peptide
MPYGCGRSQPRMR

SEQ ID NO: 2924 - protein, 13 aa, Artificial Sequence
  Synthetic Peptide
RDQFRMRGNDTFG

SEQ ID NO: 2925 - protein, 13 aa, Artificial Sequence
  Synthetic Peptide
NDTFGPRAQGWAR

SEQ ID NO: 2926 - protein, 13 aa, Artificial Sequence
  Synthetic Peptide
RAQGWARDARSGR

SEQ ID NO: 2927 - protein, 13 aa, Artificial Sequence
  Synthetic Peptide
EDPMGARGQCMSG

SEQ ID NO: 2928 - protein, 13 aa, Artificial Sequence
  Synthetic Peptide
CMSGASRLPSLFS

SEQ ID NO: 2929 - protein, 13 aa, Artificial Sequence
  Synthetic Peptide
AFPGGSRFGFGFG

SEQ ID NO: 2930 - protein, 13 aa, Artificial Sequence
  Synthetic Peptide
FATGCGRGAKLPS

SEQ ID NO: 2931 - protein, 13 aa, Artificial Sequence
  Synthetic Peptide
SGPGVARGFASPL

SEQ ID NO: 2932 - protein, 13 aa, Artificial Sequence
  Synthetic Peptide
SGMAGGRGSGGHA

SEQ ID NO: 2933 - protein, 13 aa, Artificial Sequence
  Synthetic Peptide
LRRLGARGGGKGR

SEQ ID NO: 2934 - protein, 13 aa, Artificial Sequence
  Synthetic Peptide
PRKRGGRGISFIF

SEQ ID NO: 2935 - protein, 13 aa, Artificial Sequence
  Synthetic Peptide
PVLPLYRGSSVSA

SEQ ID NO: 2936 - protein, 13 aa, Artificial Sequence
  Synthetic Peptide
SSVSASRVVKPRQ

SEQ ID NO: 2937 - protein, 13 aa, Artificial Sequence
  Synthetic Peptide
NRPIMFRGEVRLN

SEQ ID NO: 2938 - protein, 13 aa, Artificial Sequence
  Synthetic Peptide
RRDNRLRGPGGPR

SEQ ID NO: 2939 - protein, 13 aa, Artificial Sequence
  Synthetic Peptide
  misc_feature (9)..(13): Xaa can be any naturally occurring amino acid
GRGLAPRQXXXXX

SEQ ID NO: 2940 - protein, 13 aa, Artificial Sequence
  Synthetic Peptide
DIRRNDRGPGGPR

SEQ ID NO: 2941 - protein, 13 aa, Artificial Sequence
  Synthetic Peptide
RGPGGPRGIVGGG

SEQ ID NO: 2942 - protein, 13 aa, Artificial Sequence
  Synthetic Peptide
MRDRDGRGPPPRG

SEQ ID NO: 2943 - protein, 13 aa, Artificial Sequence
  Synthetic Peptide
PPLNHSRSIPMPA

SEQ ID NO: 2944 - protein, 13 aa, Artificial Sequence
  Synthetic Peptide
SGGCGGRGSKVAL

SEQ ID NO: 2945 - protein, 13 aa, Artificial Sequence
  Synthetic Peptide
GALQHSRSMSMPV

SEQ ID NO: 2946 - protein, 13 aa, Artificial Sequence
  Synthetic Peptide
SLGRGWRPLPASL

SEQ ID NO: 2947 - protein, 13 aa, Artificial Sequence
  Synthetic Peptide
VVPFSARGGRTLG

SEQ ID NO: 2948 - protein, 13 aa, Artificial Sequence
  Synthetic Peptide
KPQPPARPPPPVL

SEQ ID NO: 2949 - protein, 13 aa, Artificial Sequence
  Synthetic Peptide
IATPGTRLAGPQT

SEQ ID NO: 2950 - protein, 13 aa, Artificial Sequence
  Synthetic Peptide
GTSSRGRVRKLTE

SEQ ID NO: 2951 - protein, 13 aa, Artificial Sequence
  Synthetic Peptide
VRSSFGRGFFKIK

SEQ ID NO: 2952 - protein, 13 aa, Artificial Sequence
  Synthetic Peptide
YGPPALRFESPAT

SEQ ID NO: 2953 - protein, 13 aa, Artificial Sequence
  Synthetic Peptide
RNQSFLRTPIQRT

SEQ ID NO: 2954 - protein, 13 aa, Artificial Sequence
  Synthetic Peptide
DPAGVGRGGGVAG

SEQ ID NO: 2955 - protein, 13 aa, Artificial Sequence
  Synthetic Peptide
RLLWGSRGAGAPR

SEQ ID NO: 2956 - protein, 13 aa, Artificial Sequence
  Synthetic Peptide
  misc_feature (8)..(13): Xaa can be any naturally occurring amino acid
QPGPGYRXXXXXX

SEQ ID NO: 2957 - protein, 13 aa, Artificial Sequence
  Synthetic Peptide
DMSYSIRHSISMP

SEQ ID NO: 2958 - protein, 13 aa, Artificial Sequence
  Synthetic Peptide
QGRAIPRGTPGPP

SEQ ID NO: 2959 - protein, 13 aa, Artificial Sequence
  Synthetic Peptide
AELNGGRGHASRR

SEQ ID NO: 2960 - protein, 13 aa, Artificial Sequence
  Synthetic Peptide
KVAQPVRGCGPPR

SEQ ID NO: 2961 - protein, 13 aa, Artificial Sequence
  Synthetic Peptide
HFPLPGRGEVWGP

SEQ ID NO: 2962 - protein, 13 aa, Artificial Sequence
  Synthetic Peptide
PGYRSQREPGPGA

SEQ ID NO: 2963 - protein, 13 aa, Artificial Sequence
  Synthetic Peptide
VSGPAGRGRGGEH

SEQ ID NO: 2964 - protein, 13 aa, Artificial Sequence
  Synthetic Peptide
GPAGRGRGGEHGP

SEQ ID NO: 2965 - protein, 13 aa, Artificial Sequence
  Synthetic Peptide
PPPARGRGAPPPP

SEQ ID NO: 2966 - protein, 13 aa, Artificial Sequence
  Synthetic Peptide
RFFHMPRFQHQAP

SEQ ID NO: 2967 - protein, 13 aa, Artificial Sequence
  Synthetic Peptide
FQHQAPRQLFYKR

SEQ ID NO: 2968 - protein, 13 aa, Artificial Sequence
  Synthetic Peptide
LMGLNPRGMQGPP

SEQ ID NO: 2969 - protein, 13 aa, Artificial Sequence
  Synthetic Peptide
LLGDGPRAPFNQE

SEQ ID NO: 2970 - protein, 13 aa, Artificial Sequence
  Synthetic Peptide
LREFEGRGGPLPQ

SEQ ID NO: 2971 - protein, 13 aa, Artificial Sequence
  Synthetic Peptide
QEEKWRRGGPGPP

SEQ ID NO: 2972 - protein, 13 aa, Artificial Sequence
  Synthetic Peptide
EEAARGRDLRGRG

SEQ ID NO: 2973 - protein, 13 aa, Artificial Sequence
  Synthetic Peptide
GGPSEDRGGKGRG

SEQ ID NO: 2974 - protein, 13 aa, Artificial Sequence
  Synthetic Peptide
DRGGKGRGGPGPA

SEQ ID NO: 2975 - protein, 13 aa, Artificial Sequence
  Synthetic Peptide
GSEPPSRGKPPPP

SEQ ID NO: 2976 - protein, 13 aa, Artificial Sequence
  Synthetic Peptide
PPTPAPRTMPPTK

SEQ ID NO: 2977 - protein, 13 aa, Artificial Sequence
  Synthetic Peptide
REKRRGRGTGEAE

SEQ ID NO: 2978 - protein, 13 aa, Artificial Sequence
  Synthetic Peptide
SESVKSRGLPCTE

SEQ ID NO: 2979 - protein, 13 aa, Artificial Sequence
  Synthetic Peptide
PSHGSGRGALPGP

SEQ ID NO: 2980 - protein, 13 aa, Artificial Sequence
  Synthetic Peptide
GTSLSGRGPTPSL

SEQ ID NO: 2981 - protein, 13 aa, Artificial Sequence
  Synthetic Peptide
MSVTGGRGGPRPV

SEQ ID NO: 2982 - protein, 13 aa, Artificial Sequence
  Synthetic Peptide
GGRGGPRPVSSSI

SEQ ID NO: 2983 - protein, 13 aa, Artificial Sequence
  Synthetic Peptide
LAGSSGRGGQTVK

SEQ ID NO: 2984 - protein, 13 aa, Artificial Sequence
  Synthetic Peptide
YEGRWGRGTAQYS

SEQ ID NO: 2985 - protein, 13 aa, Artificial Sequence
  Synthetic Peptide
TARGTSRGQYHTL

SEQ ID NO: 2986 - protein, 13 aa, Artificial Sequence
  Synthetic Peptide
QSSHRSRGVGGAV

SEQ ID NO: 2987 - protein, 13 aa, Artificial Sequence
  Synthetic Peptide
GRADGKRGSWRTG

SEQ ID NO: 2988 - protein, 13 aa, Artificial Sequence
  Synthetic Peptide
PGQSHARGGHWLA

SEQ ID NO: 2989 - protein, 13 aa, Artificial Sequence
  Synthetic Peptide
WRRKHPRTSGGTR

SEQ ID NO: 2990 - protein, 13 aa, Artificial Sequence
  Synthetic Peptide
RTSGGTRGVLSGN

SEQ ID NO: 2991 - protein, 13 aa, Artificial Sequence
  Synthetic Peptide
VEYGSGRGHLGTF

SEQ ID NO: 2992 - protein, 13 aa, Artificial Sequence
  Synthetic Peptide
NVPTNVRSSFPVS

SEQ ID NO: 2993 - protein, 13 aa, Artificial Sequence
  Synthetic Peptide
NFNYEQRGAFRGS

SEQ ID NO: 2994 - protein, 13 aa, Artificial Sequence
  Synthetic Peptide
EQRGAFRGSRGGR

SEQ ID NO: 2995 - protein, 13 aa, Artificial Sequence
  Synthetic Peptide
GAFRGSRGGRGWG

SEQ ID NO: 2996 - protein, 13 aa, Artificial Sequence
  Synthetic Peptide
RGSRGGRGWGTRG

SEQ ID NO: 2997 - protein, 13 aa, Artificial Sequence
  Synthetic Peptide
GDRHSERPGAAAA

SEQ ID NO: 2998 - protein, 13 aa, Artificial Sequence
  Synthetic Peptide
AAAAVARGGGGGG

SEQ ID NO: 2999 - protein, 13 aa, Artificial Sequence
  Synthetic Peptide
GGDGGGRRGRGRG

SEQ ID NO: 3000 - protein, 13 aa, Artificial Sequence
  Synthetic Peptide
WDRNLGRGSSAPS

SEQ ID NO: 3001 - protein, 13 aa, Artificial Sequence
  Synthetic Peptide
PQPGMQRFRTEAA

SEQ ID NO: 3002 - protein, 13 aa, Artificial Sequence
  Synthetic Peptide
WEPRPLRAASPFR

SEQ ID NO: 3003 - protein, 13 aa, Artificial Sequence
  Synthetic Peptide
PPLYPLRPEPPQP

SEQ ID NO: 3004 - protein, 13 aa, Artificial Sequence
  Synthetic Peptide
QPPISWRVRGGGP

SEQ ID NO: 3005 - protein, 13 aa, Artificial Sequence
  Synthetic Peptide
PISWRVRGGGPAE

SEQ ID NO: 3006 - protein, 13 aa, Artificial Sequence
  Synthetic Peptide
YWNSTARSRAPYP

SEQ ID NO: 3007 - protein, 13 aa, Artificial Sequence
  Synthetic Peptide
SPTPVSRWIYPQQ

SEQ ID NO: 3008 - protein, 13 aa, Artificial Sequence
  Synthetic Peptide
TEAPPLRGQVPGY

SEQ ID NO: 3009 - protein, 13 aa, Artificial Sequence
  Synthetic Peptide
LPCSLGRGAAPSE

SEQ ID NO: 3010 - protein, 13 aa, Artificial Sequence
  Synthetic Peptide
PSQAQARLPSGEV

SEQ ID NO: 3011 - protein, 13 aa, Artificial Sequence
  Synthetic Peptide
NPLPGGRNFSGTA

SEQ ID NO: 3012 - protein, 13 aa, Artificial Sequence
  Synthetic Peptide
HLSHLNRFPARGP

SEQ ID NO: 3013 - protein, 13 aa, Artificial Sequence
  Synthetic Peptide
VNTNVPRASVPDG

SEQ ID NO: 3014 - protein, 13 aa, Artificial Sequence
  Synthetic Peptide
SEGLSPRPPNSPS

SEQ ID NO: 3015 - protein, 13 aa, Artificial Sequence
  Synthetic Peptide
AYAAHGRGALAEA

SEQ ID NO: 3016 - protein, 13 aa, Artificial Sequence
  Synthetic Peptide
QTEALMRGKSTEE

SEQ ID NO: 3017 - protein, 13 aa, Artificial Sequence
  Synthetic Peptide
QGLRDARGGPSHS

SEQ ID NO: 3018 - protein, 13 aa, Artificial Sequence
  Synthetic Peptide
GAGPNARGPGRMR

SEQ ID NO: 3019 - protein, 13 aa, Artificial Sequence
  Synthetic Peptide
PEGGSGRGRRAER

SEQ ID NO: 3020 - protein, 13 aa, Artificial Sequence
  Synthetic Peptide
RRTLAFRGGGGGG

SEQ ID NO: 3021 - protein, 13 aa, Artificial Sequence
  Synthetic Peptide
RQRGNLRGHLRLH

SEQ ID NO: 3022 - protein, 13 aa, Artificial Sequence
  Synthetic Peptide
QRLGGGRGGPSRR

SEQ ID NO: 3023 - protein, 13 aa, Artificial Sequence
  Synthetic Peptide
ANGKGRRGSLNAS

SEQ ID NO: 3024 - protein, 13 aa, Artificial Sequence
  Synthetic Peptide
TPPYGPRSRPYGS

SEQ ID NO: 3025 - protein, 13 aa, Artificial Sequence
  Synthetic Peptide
PYGPRSRPYGSSH

SEQ ID NO: 3026 - protein, 13 aa, Artificial Sequence
  Synthetic Peptide
GSSHSPRHGGSFP

SEQ ID NO: 3027 - protein, 13 aa, Artificial Sequence
  Synthetic Peptide
TPFGSGRVREKRM

SEQ ID NO: 3028 - protein, 13 aa, Artificial Sequence
  Synthetic Peptide
PAQPAARGRLCRG

SEQ ID NO: 3029 - protein, 13 aa, Artificial Sequence
  Synthetic Peptide
PINSPARGTPSPK

SEQ ID NO: 3030 - protein, 13 aa, Artificial Sequence
  Synthetic Peptide
FLCALGRGIPILS

SEQ ID NO: 3031 - protein, 13 aa, Artificial Sequence
  Synthetic Peptide
GQNSASRGGSQRG

SEQ ID NO: 3032 - protein, 13 aa, Artificial Sequence
  Synthetic Peptide
ALASQYRAMMPPY

SEQ ID NO: 3033 - protein, 13 aa, Artificial Sequence
  Synthetic Peptide
MFQQYPRMTYPPL

SEQ ID NO: 3034 - protein, 13 aa, Artificial Sequence
  Synthetic Peptide
PLHGPMRFPPSLS

SEQ ID NO: 3035 - protein, 13 aa, Artificial Sequence
  Synthetic Peptide
ETNKGLRGRGPPP

SEQ ID NO: 3036 - protein, 13 aa, Artificial Sequence
  Synthetic Peptide
NKGLRGRGPPPSW

SEQ ID NO: 3037 - protein, 13 aa, Artificial Sequence
  Synthetic Peptide
WASEPERPSILSA

SEQ ID NO: 3038 - protein, 13 aa, Artificial Sequence
  Synthetic Peptide
QSYMDPRMMSGRP

SEQ ID NO: 3039 - protein, 13 aa, Artificial Sequence
  Synthetic Peptide
FPDQGYRGRGRGE

SEQ ID NO: 3040 - protein, 13 aa, Artificial Sequence
  Synthetic Peptide
DQGYRGRGRGEYY

SEQ ID NO: 3041 - protein, 13 aa, Artificial Sequence
  Synthetic Peptide
GYRGRGRGEYYSR

SEQ ID NO: 3042 - protein, 13 aa, Artificial Sequence
  Synthetic Peptide
RGEYYSRGRSYRG

SEQ ID NO: 3043 - protein, 13 aa, Artificial Sequence
  Synthetic Peptide
EYYSRGRSYRGSY

SEQ ID NO: 3044 - protein, 13 aa, Artificial Sequence
  Synthetic Peptide
RGGTFRRGGRDPG

SEQ ID NO: 3045 - protein, 13 aa, Artificial Sequence
  Synthetic Peptide
TFRRGGRDPGGRP

SEQ ID NO: 3046 - protein, 13 aa, Artificial Sequence
  Synthetic Peptide
GRDPGGRPSRPST

SEQ ID NO: 3047 - protein, 13 aa, Artificial Sequence
  Synthetic Peptide
QVSQPFRGLIPAG

SEQ ID NO: 3048 - protein, 13 aa, Artificial Sequence
  Synthetic Peptide
PTSSPFRATSTSP

SEQ ID NO: 3049 - protein, 13 aa, Artificial Sequence
  Synthetic Peptide
SAPATVRMTQPFP

SEQ ID NO: 3050 - protein, 13 aa, Artificial Sequence
  Synthetic Peptide
DPFGPRRGGMIVD

SEQ ID NO: 3051 - protein, 13 aa, Artificial Sequence
  Synthetic Peptide
SSGLPNRLPPGAV

SEQ ID NO: 3052 - protein, 13 aa, Artificial Sequence
  Synthetic Peptide
RNSPFTRGRREDY

SEQ ID NO: 3053 - protein, 13 aa, Artificial Sequence
  Synthetic Peptide
GPRRGRRGRPPAL

SEQ ID NO: 3054 - protein, 13 aa, Artificial Sequence
  Synthetic Peptide
RRGRRGRPPALLA

SEQ ID NO: 3055 - protein, 13 aa, Artificial Sequence
  Synthetic Peptide
ASGSKARGLWPFA

SEQ ID NO: 3056 - protein, 13 aa, Artificial Sequence
  Synthetic Peptide
FPAAGGRGGGSGG

SEQ ID NO: 3057 - protein, 13 aa, Artificial Sequence
  Synthetic Peptide
VLRLTGRGGGGTV

SEQ ID NO: 3058 - protein, 13 aa, Artificial Sequence
  Synthetic Peptide
TVVGAPRGRSSSR

SEQ ID NO: 3059 - protein, 13 aa, Artificial Sequence
  Synthetic Peptide
VGAPRGRSSSRGR

SEQ ID NO: 3060 - protein, 13 aa, Artificial Sequence
  Synthetic Peptide
VEGVFGRGGGREM

SEQ ID NO: 3061 - protein, 13 aa, Artificial Sequence
  Synthetic Peptide
QAGGWGRGGGGGA

SEQ ID NO: 3062 - protein, 13 aa, Artificial Sequence
  Synthetic Peptide
GGGGGARPAAEPP

SEQ ID NO: 3063 - protein, 13 aa, Artificial Sequence
  Synthetic Peptide
KIQASFRGHMARK

SEQ ID NO: 3064 - protein, 13 aa, Artificial Sequence
  Synthetic Peptide
GGAGVARGGAGGG

SEQ ID NO: 3065 - protein, 13 aa, Artificial Sequence
  Synthetic Peptide
RPSSAYRGGVRYS

SEQ ID NO: 3066 - protein, 13 aa, Artificial Sequence
  Synthetic Peptide
CALAKPRASSLGP

SEQ ID NO: 3067 - protein, 13 aa, Artificial Sequence
  Synthetic Peptide
RSASSPRGMVRVC

SEQ ID NO: 3068 - protein, 13 aa, Artificial Sequence
  Synthetic Peptide
SLSPTARTLHFQS

SEQ ID NO: 3069 - protein, 13 aa, Artificial Sequence
  Synthetic Peptide
AGAAGGRGKGAYQ

SEQ ID NO: 3070 - protein, 13 aa, Artificial Sequence
  Synthetic Peptide
KLIVDGRGKATIS

SEQ ID NO: 3071 - protein, 13 aa, Artificial Sequence
  Synthetic Peptide
APTAAGRGRGRGR

SEQ ID NO: 3072 - protein, 13 aa, Artificial Sequence
  Synthetic Peptide
TAAGRGRGRGRPH

SEQ ID NO: 3073 - protein, 13 aa, Artificial Sequence
  Synthetic Peptide
  misc_feature (12)..(13): Xaa can be any naturally occurring amino acid
AGRGRGRGRPHXX

SEQ ID NO: 3074 - protein, 13 aa, Artificial Sequence
  Synthetic Peptide
  misc_feature (10)..(13): Xaa can be any naturally occurring amino acid
RGRGRGRPHXXXX

SEQ ID NO: 3075 - protein, 13 aa, Artificial Sequence
  Synthetic Peptide
PRGSRSRGTGSFF

SEQ ID NO: 3076 - protein, 13 aa, Artificial Sequence
  Synthetic Peptide
  misc_feature (1)..(2): Xaa can be any naturally occurring amino acid
XXMTERRVPFSLL

SEQ ID NO: 3077 - protein, 13 aa, Artificial Sequence
  Synthetic Peptide
VPFSLLRGPSWDP

SEQ ID NO: 3078 - protein, 13 aa, Artificial Sequence
  Synthetic Peptide
SWPGYVRPLPPAA

SEQ ID NO: 3079 - protein, 13 aa, Artificial Sequence
  Synthetic Peptide
SQQMVNRLSIPKP

SEQ ID NO: 3080 - protein, 13 aa, Artificial Sequence
  Synthetic Peptide
GGLRLSRPPAPPP

SEQ ID NO: 3081 - protein, 13 aa, Artificial Sequence
  Synthetic Peptide
LATFPSRGAKASP

SEQ ID NO: 3082 - protein, 13 aa, Artificial Sequence
  Synthetic Peptide
VQLEVGRPQAPLN

SEQ ID NO: 3083 - protein, 13 aa, Artificial Sequence
  Synthetic Peptide
FGHQVNRQVFRQG

SEQ ID NO: 3084 - protein, 13 aa, Artificial Sequence
  Synthetic Peptide
DCGQVLRGGVIQS

SEQ ID NO: 3085 - protein, 13 aa, Artificial Sequence
  Synthetic Peptide
RAGATSRGGQAPG

SEQ ID NO: 3086 - protein, 13 aa, Artificial Sequence
  Synthetic Peptide
SSMWGPRAVQVPD

SEQ ID NO: 3087 - protein, 13 aa, Artificial Sequence
  Synthetic Peptide
PQQGAVRPQTLNF

SEQ ID NO: 3088 - protein, 13 aa, Artificial Sequence
  Synthetic Peptide
TGGGRGRGMRSRG

SEQ ID NO: 3089 - protein, 13 aa, Artificial Sequence
  Synthetic Peptide
GRGRGMRSRGRGG

SEQ ID NO: 3090 - protein, 13 aa, Artificial Sequence
  Synthetic Peptide
GRGRGMRSRGRGF

SEQ ID NO: 3091 - protein, 13 aa, Artificial Sequence
  Synthetic Peptide
ACYNCGRGGHIAK

SEQ ID NO: 3092 - protein, 13 aa, Artificial Sequence
  Synthetic Peptide
GTPLAVRALTPVS

SEQ ID NO: 3093 - protein, 13 aa, Artificial Sequence
  Synthetic Peptide
GRPGTGRGVASEG

SEQ ID NO: 3094 - protein, 13 aa, Artificial Sequence
  Synthetic Peptide
APATAPRRAGEAK

SEQ ID NO: 3095 - protein, 13 aa, Artificial Sequence
  Synthetic Peptide
AKSRSSRAGLQFP

SEQ ID NO: 3096 - protein, 13 aa, Artificial Sequence
  Synthetic Peptide
FTRSFFRGRPDLS

SEQ ID NO: 3097 - protein, 13 aa, Artificial Sequence
  Synthetic Peptide
SKSRSSRAGLQFP

SEQ ID NO: 3098 - protein, 13 aa, Artificial Sequence
  Synthetic Peptide
VHGNFPRLSYPTF

SEQ ID NO: 3099 - protein, 13 aa, Artificial Sequence
  Synthetic Peptide
MCQKQCRDENGFK

SEQ ID NO: 3100 - protein, 13 aa, Artificial Sequence
  Synthetic Peptide
RDREAGRGLGRMR

SEQ ID NO: 3101 - protein, 13 aa, Artificial Sequence
  Synthetic Peptide
SFYKFDRHGVPDE

SEQ ID NO: 3102 - protein, 13 aa, Artificial Sequence
  Synthetic Peptide
GVPDEMRKVESNW

SEQ ID NO: 3103 - protein, 13 aa, Artificial Sequence
  Synthetic Peptide
VHSGIARSPHPSS

SEQ ID NO: 3104 - protein, 13 aa, Artificial Sequence
  Synthetic Peptide
FPHTAIRYPPHLN

SEQ ID NO: 3105 - protein, 13 aa, Artificial Sequence
  Synthetic Peptide
PPPGLPRLALPPA

SEQ ID NO: 3106 - protein, 13 aa, Artificial Sequence
  Synthetic Peptide
VPPKRARGGLWDD

SEQ ID NO: 3107 - protein, 13 aa, Artificial Sequence
  Synthetic Peptide
IRQTVNRGGGGFG

SEQ ID NO: 3108 - protein, 13 aa, Artificial Sequence
  Synthetic Peptide
VPFGGFRVQGGMA

SEQ ID NO: 3109 - protein, 13 aa, Artificial Sequence
  Synthetic Peptide
GGPQPLRRQPPPF

SEQ ID NO: 3110 - protein, 13 aa, Artificial Sequence
  Synthetic Peptide
GPQPLRRQPPPFP

SEQ ID NO: 3111 - protein, 13 aa, Artificial Sequence
  Synthetic Peptide
VAPCVPRFVRSNN

SEQ ID NO: 3112 - protein, 13 aa, Artificial Sequence
  Synthetic Peptide
GAPGTPRMNLSSN

SEQ ID NO: 3113 - protein, 13 aa, Artificial Sequence
  Synthetic Peptide
CGPVGVRKEMHCG

SEQ ID NO: 3114 - protein, 13 aa, Artificial Sequence
  Synthetic Peptide
PSPLALRQPVKAF

SEQ ID NO: 3115 - protein, 13 aa, Artificial Sequence
  Synthetic Peptide
GGIPVPRSKLAQP

SEQ ID NO: 3116 - protein, 13 aa, Artificial Sequence
  Synthetic Peptide
PQGGSPRGSHHTS

SEQ ID NO: 3117 - protein, 13 aa, Artificial Sequence
  Synthetic Peptide
VPLLGSRLPYQPP

SEQ ID NO: 3118 - protein, 13 aa, Artificial Sequence
  Synthetic Peptide
LGHDPYRLGHDAY

SEQ ID NO: 3119 - protein, 13 aa, Artificial Sequence
  Synthetic Peptide
LGHDAYRLGQDPY

SEQ ID NO: 3120 - protein, 13 aa, Artificial Sequence
  Synthetic Peptide
LGQDPYRLGHDPY

SEQ ID NO: 3121 - protein, 13 aa, Artificial Sequence
  Synthetic Peptide
LMLASRRSMMMSY

SEQ ID NO: 3122 - protein, 13 aa, Artificial Sequence
  Synthetic Peptide
MMSSYERSMMSYE

SEQ ID NO: 3123 - protein, 13 aa, Artificial Sequence
  Synthetic Peptide
MSMGADRSMMSSY

SEQ ID NO: 3124 - protein, 13 aa, Artificial Sequence
  Synthetic Peptide
SYSAADRSMMSSY

SEQ ID NO: 3125 - protein, 13 aa, Artificial Sequence
  Synthetic Peptide
GPQLPGRGGRRAA

SEQ ID NO: 3126 - protein, 13 aa, Artificial Sequence
  Synthetic Peptide
CKEGGGRGTNLGK

SEQ ID NO: 3127 - protein, 13 aa, Artificial Sequence
  Synthetic Peptide
QPFMSPRYAGGPR

SEQ ID NO: 3128 - protein, 13 aa, Artificial Sequence
  Synthetic Peptide
LTAPNYRLKSLIK

SEQ ID NO: 3129 - protein, 13 aa, Artificial Sequence
  Synthetic Peptide
ASRIGLRMQLMRE

SEQ ID NO: 3130 - protein, 13 aa, Artificial Sequence
  Synthetic Peptide
PTIFPLRGVNERK

SEQ ID NO: 3131 - protein, 13 aa, Artificial Sequence
  Synthetic Peptide
THPWLPRSGNASM

SEQ ID NO: 3132 - protein, 13 aa, Artificial Sequence
  Synthetic Peptide
LGHGVPRLPPGRK

SEQ ID NO: 3133 - protein, 13 aa, Artificial Sequence
  Synthetic Peptide
PPGPPPRGPPPRL

SEQ ID NO: 3134 - protein, 13 aa, Artificial Sequence
  Synthetic Peptide
VMIGSPRGGASNF

SEQ ID NO: 3135 - protein, 13 aa, Artificial Sequence
  Synthetic Peptide
PPGPFMRPGSMGL

SEQ ID NO: 3136 - protein, 13 aa, Artificial Sequence
  Synthetic Peptide
GSMGLPRFYPAGR

SEQ ID NO: 3137 - protein, 13 aa, Artificial Sequence
  Synthetic Peptide
RFYPAGRARGIPH

SEQ ID NO: 3138 - protein, 13 aa, Artificial Sequence
  Synthetic Peptide
YPAGRARGIPHRF

SEQ ID NO: 3139 - protein, 13 aa, Artificial Sequence
  Synthetic Peptide
ARGIPHRFAGHES

SEQ ID NO: 3140 - protein, 13 aa, Artificial Sequence
  Synthetic Peptide
TPRAGLRLVAPDV

SEQ ID NO: 3141 - protein, 13 aa, Artificial Sequence
  Synthetic Peptide
MLMVTNRGRNKIL

SEQ ID NO: 3142 - protein, 13 aa, Artificial Sequence
  Synthetic Peptide
FAEFSMRGRMREK

SEQ ID NO: 3143 - protein, 13 aa, Artificial Sequence
  Synthetic Peptide
ADPHGKRVFSMFL

SEQ ID NO: 3144 - protein, 13 aa, Artificial Sequence
  Synthetic Peptide
MTAYGTRRHLYDP

SEQ ID NO: 3145 - protein, 13 aa, Artificial Sequence
  Synthetic Peptide
PSSASLRGCRESK

SEQ ID NO: 3146 - protein, 13 aa, Artificial Sequence
  Synthetic Peptide
QGMAAFRPRGRRS

SEQ ID NO: 3147 - protein, 13 aa, Artificial Sequence
  Synthetic Peptide
ARGAAGRGAAGLG

SEQ ID NO: 3148 - protein, 13 aa, Artificial Sequence
  Synthetic Peptide
RAKVYGRGLSEGR

SEQ ID NO: 3149 - protein, 13 aa, Artificial Sequence
  Synthetic Peptide
SLFAALRGRGARA

SEQ ID NO: 3150 - protein, 13 aa, Artificial Sequence
  Synthetic Peptide
LKQEQLRLQGLQG

SEQ ID NO: 3151 - protein, 13 aa, Artificial Sequence
  Synthetic Peptide
LQGSGGRGGGLRR

SEQ ID NO: 3152 - protein, 13 aa, Artificial Sequence
  Synthetic Peptide
GRGGGLRRPPARF

SEQ ID NO: 3153 - protein, 13 aa, Artificial Sequence
  Synthetic Peptide
DGGGRSRGAGSAQ

SEQ ID NO: 3154 - protein, 13 aa, Artificial Sequence
  Synthetic Peptide
SQPVAVRGGGGKQ

SEQ ID NO: 3155 - protein, 13 aa, Artificial Sequence
  Synthetic Peptide
ISISVARGGGRGS

SEQ ID NO: 3156 - protein, 13 aa, Artificial Sequence
  Synthetic Peptide
AGGSGSRISVSRS

SEQ ID NO: 3157 - protein, 13 aa, Artificial Sequence
  Synthetic Peptide
SRISVSRSTSFRG

SEQ ID NO: 3158 - protein, 13 aa, Artificial Sequence
  Synthetic Peptide
MTSYSYRQSSATS

SEQ ID NO: 3159 - protein, 13 aa, Artificial Sequence
  Synthetic Peptide
LGGGSVRFGPGVA

SEQ ID NO: 3160 - protein, 13 aa, Artificial Sequence
  Synthetic Peptide
GPGVAFRAPSIHG

SEQ ID NO: 3161 - protein, 13 aa, Artificial Sequence
  Synthetic Peptide
HGGSGGRGVSVSS

SEQ ID NO: 3162 - protein, 13 aa, Artificial Sequence
  Synthetic Peptide
VSVSSARFVSSSS

SEQ ID NO: 3163 - protein, 13 aa, Artificial Sequence
  Synthetic Peptide
YGGAGGRGIRISN

SEQ ID NO: 3164 - protein, 13 aa, Artificial Sequence
  Synthetic Peptide
VSTSGPRAFSSRS

SEQ ID NO: 3165 - protein, 13 aa, Artificial Sequence
  Synthetic Peptide
PRAFSSRSYTSGP

SEQ ID NO: 3166 - protein, 13 aa, Artificial Sequence
  Synthetic Peptide
TSGPGSRISSSSF

SEQ ID NO: 3167 - protein, 13 aa, Artificial Sequence
  Synthetic Peptide
SSSSFSRVGSSNF

SEQ ID NO: 3168 - protein, 13 aa, Artificial Sequence
  Synthetic Peptide
VGSSNFRGGLGGG

SEQ ID NO: 3169 - protein, 13 aa, Artificial Sequence
  Synthetic Peptide
GDNLVTRSYLLGN

SEQ ID NO: 3170 - protein, 13 aa, Artificial Sequence
  Synthetic Peptide
PPRMGSRAGGPTT

SEQ ID NO: 3171 - protein, 13 aa, Artificial Sequence
  Synthetic Peptide
GQGNSRRGLNKPS

SEQ ID NO: 3172 - protein, 13 aa, Artificial Sequence
  Synthetic Peptide
VQAVNQRGRSPRS

SEQ ID NO: 3173 - protein, 13 aa, Artificial Sequence
  Synthetic Peptide
SRAGSRRGSFDAT

SEQ ID NO: 3174 - protein, 13 aa, Artificial Sequence
  Synthetic Peptide
GGWKRLRGMGRAE

SEQ ID NO: 3175 - protein, 13 aa, Artificial Sequence
  Synthetic Peptide
RLRGMGRAEAMAA

SEQ ID NO: 3176 - protein, 13 aa, Artificial Sequence
  Synthetic Peptide
EEGPRGRGLAARP

SEQ ID NO: 3177 - protein, 13 aa, Artificial Sequence
  Synthetic Peptide
LQMGTNRGASQAG

SEQ ID NO: 3178 - protein, 13 aa, Artificial Sequence
  Synthetic Peptide
ATIKTKRSIQFVD

SEQ ID NO: 3179 - protein, 13 aa, Artificial Sequence
  Synthetic Peptide
AAIKTKRSIQFVD

SEQ ID NO: 3180 - protein, 13 aa, Artificial Sequence
  Synthetic Peptide
TVAAVFRGRMSMK

SEQ ID NO: 3181 - protein, 13 aa, Artificial Sequence
  Synthetic Peptide
KILIVGRESGTIQ

SEQ ID NO: 3182 - protein, 13 aa, Artificial Sequence
  Synthetic Peptide
SRHASERGHLRGP

SEQ ID NO: 3183 - protein, 13 aa, Artificial Sequence
  Synthetic Peptide
SERGHLRGPSSYR

SEQ ID NO: 3184 - protein, 13 aa, Artificial Sequence
  Synthetic Peptide
SYSGGTRTSSGRL

SEQ ID NO: 3185 - protein, 13 aa, Artificial Sequence
  Synthetic Peptide
RGAPGGRGAQLSV

SEQ ID NO: 3186 - protein, 13 aa, Artificial Sequence
  Synthetic Peptide
CQLGGGRGVSTCS

SEQ ID NO: 3187 - protein, 13 aa, Artificial Sequence
  Synthetic Peptide
VSTCSTRFVSGGS

SEQ ID NO: 3188 - protein, 13 aa, Artificial Sequence
  Synthetic Peptide
SRSTSFRGGMGSG

SEQ ID NO: 3189 - protein, 13 aa, Artificial Sequence
  Synthetic Peptide
VSVSRSRGSGGLG

SEQ ID NO: 3190 - protein, 13 aa, Artificial Sequence
  Synthetic Peptide
ISVSRSRGSGGLG

SEQ ID NO: 3191 - protein, 13 aa, Artificial Sequence
  Synthetic Peptide
GRGAQVRLSSARP

SEQ ID NO: 3192 - protein, 13 aa, Artificial Sequence
  Synthetic Peptide
YGLGASRPRVAVR

SEQ ID NO: 3193 - protein, 13 aa, Artificial Sequence
  Synthetic Peptide
LGASRPRVAVRSA

SEQ ID NO: 3194 - protein, 13 aa, Artificial Sequence
  Synthetic Peptide
LDPKDIRLPPPMP

SEQ ID NO: 3195 - protein, 13 aa, Artificial Sequence
  Synthetic Peptide
  misc_feature (1)..(2): Xaa can be any naturally occurring amino acid
XXMGRRRAPAGGS

SEQ ID NO: 3196 - protein, 13 aa, Artificial Sequence
  Synthetic Peptide
AGGSLGRALMRHQ

SEQ ID NO: 3197 - protein, 13 aa, Artificial Sequence
  Synthetic Peptide
PPLQSARSLPGPA

SEQ ID NO: 3198 - protein, 13 aa, Artificial Sequence
  Synthetic Peptide
AQRRRTRGTPPGL

SEQ ID NO: 3199 - protein, 13 aa, Artificial Sequence
  Synthetic Peptide
MALRAMRGIVNGA

SEQ ID NO: 3200 - protein, 13 aa, Artificial Sequence
  Synthetic Peptide
TSVSNPRGRPSRG

SEQ ID NO: 3201 - protein, 13 aa, Artificial Sequence
  Synthetic Peptide
PRGRPSRGRPPKL

SEQ ID NO: 3202 - protein, 13 aa, Artificial Sequence
  Synthetic Peptide
LPASLGRGWGREE

SEQ ID NO: 3203 - protein, 13 aa, Artificial Sequence
  Synthetic Peptide
IQYQMDRGRRVSG

SEQ ID NO: 3204 - protein, 13 aa, Artificial Sequence
  Synthetic Peptide
AGKGIGRGTVQAL

SEQ ID NO: 3205 - protein, 13 aa, Artificial Sequence
  Synthetic Peptide
PTPCFGRGKTLKW

SEQ ID NO: 3206 - protein, 13 aa, Artificial Sequence
  Synthetic Peptide
SSFFSDRGSGSRG

SEQ ID NO: 3207 - protein, 13 aa, Artificial Sequence
  Synthetic Peptide
RGRSKSRFSGGFG

SEQ ID NO: 3208 - protein, 13 aa, Artificial Sequence
  Synthetic Peptide
SSFSSSRASSSRS

SEQ ID NO: 3209 - protein, 13 aa, Artificial Sequence
  Synthetic Peptide
GGHGSSRGFGGGG

SEQ ID NO: 3210 - protein, 13 aa, Artificial Sequence
  Synthetic Peptide
ERYTENRGSSRHS

SEQ ID NO: 3211 - protein, 13 aa, Artificial Sequence
  Synthetic Peptide
GRHGENRGANDGR

SEQ ID NO: 3212 - protein, 13 aa, Artificial Sequence
  Synthetic Peptide
TAGSGGRGGGGGR

SEQ ID NO: 3213 - protein, 13 aa, Artificial Sequence
  Synthetic Peptide
RGGGGGRRQQPPL

SEQ ID NO: 3214 - protein, 13 aa, Artificial Sequence
  Synthetic Peptide
GSQGLGRHLPAER

SEQ ID NO: 3215 - protein, 13 aa, Artificial Sequence
  Synthetic Peptide
GSRGRLRGGLGWE

SEQ ID NO: 3216 - protein, 13 aa, Artificial Sequence
  Synthetic Peptide
DVSNMGRGARQKL

SEQ ID NO: 3217 - protein, 13 aa, Artificial Sequence
  Synthetic Peptide
NMGRGARQKLLGR

SEQ ID NO: 3218 - protein, 13 aa, Artificial Sequence
  Synthetic Peptide
WVCSSLRHAQPTC

SEQ ID NO: 3219 - protein, 13 aa, Artificial Sequence
  Synthetic Peptide
WTGYQGRFAVDPR

SEQ ID NO: 3220 - protein, 13 aa, Artificial Sequence
  Synthetic Peptide
LLQTHGRGSPIPY

SEQ ID NO: 3221 - protein, 13 aa, Artificial Sequence
  Synthetic Peptide
QINRNIRFATYTK

SEQ ID NO: 3222 - protein, 13 aa, Artificial Sequence
  Synthetic Peptide
QVVGMGRGLLNYP

SEQ ID NO: 3223 - protein, 13 aa, Artificial Sequence
  Synthetic Peptide
GLLNYPRVRELYA

SEQ ID NO: 3224 - protein, 13 aa, Artificial Sequence
  Synthetic Peptide
YERKKGRGFPQTF

SEQ ID NO: 3225 - protein, 13 aa, Artificial Sequence
  Synthetic Peptide
TLEGFRRKEFRGK

SEQ ID NO: 3226 - protein, 13 aa, Artificial Sequence
  Synthetic Peptide
FPTEGERRQLLQD

SEQ ID NO: 3227 - protein, 13 aa, Artificial Sequence
  Synthetic Peptide
LAGFQQRALCHAL

SEQ ID NO: 3228 - protein, 13 aa, Artificial Sequence
  Synthetic Peptide
TKISKGRGSLPPQ

SEQ ID NO: 3229 - protein, 13 aa, Artificial Sequence
  Synthetic Peptide
GQVVGTRGGFRGC

SEQ ID NO: 3230 - protein, 13 aa, Artificial Sequence
  Synthetic Peptide
KQKSEKRDRTQNR

SEQ ID NO: 3231 - protein, 13 aa, Artificial Sequence
  Synthetic Peptide
KSEKRDRTQNRSR

SEQ ID NO: 3232 - protein, 13 aa, Artificial Sequence
  Synthetic Peptide
RTQNRSRSRSRER

SEQ ID NO: 3233 - protein, 13 aa, Artificial Sequence
  Synthetic Peptide
RWQGDARQKALKD

SEQ ID NO: 3234 - protein, 13 aa, Artificial Sequence
  Synthetic Peptide
VEGQLLRGLSKYG

SEQ ID NO: 3235 - protein, 13 aa, Artificial Sequence
  Synthetic Peptide
YDKCPKRVYYLSL

SEQ ID NO: 3236 - protein, 13 aa, Artificial Sequence
  Synthetic Peptide
LDRGQGRGGGGGG

SEQ ID NO: 3237 - protein, 13 aa, Artificial Sequence
  Synthetic Peptide
LGSRLLRGVGGSH

SEQ ID NO: 3238 - protein, 13 aa, Artificial Sequence
  Synthetic Peptide
LAPLPGRAGGAAS

SEQ ID NO: 3239 - protein, 13 aa, Artificial Sequence
  Synthetic Peptide
LPGSHVRLPGRAQ

SEQ ID NO: 3240 - protein, 13 aa, Artificial Sequence
  Synthetic Peptide
HVRLPGRAQSGTR

SEQ ID NO: 3241 - protein, 13 aa, Artificial Sequence
  Synthetic Peptide
RAQSGTRGGAGNT

SEQ ID NO: 3242 - protein, 13 aa, Artificial Sequence
  Synthetic Peptide
WPEEVSRGGRSRA

SEQ ID NO: 3243 - protein, 13 aa, Artificial Sequence
  Synthetic Peptide
LGGWFGRGCTKRT

SEQ ID NO: 3244 - protein, 13 aa, Artificial Sequence
  Synthetic Peptide
AGGTLGRAGAGRG

SEQ ID NO: 3245 - protein, 13 aa, Artificial Sequence
  Synthetic Peptide
GRAGAGRGAPEGP

SEQ ID NO: 3246 - protein, 13 aa, Artificial Sequence
  Synthetic Peptide
HTLYQPRFGNSQS

SEQ ID NO: 3247 - protein, 13 aa, Artificial Sequence
  Synthetic Peptide
LLSSHVRGVGSRG

SEQ ID NO: 3248 - protein, 13 aa, Artificial Sequence
  Synthetic Peptide
SKVTCGRGGWVYV

SEQ ID NO: 3249 - protein, 13 aa, Artificial Sequence
  Synthetic Peptide
PLRMSRRGMVRKS

SEQ ID NO: 3250 - protein, 13 aa, Artificial Sequence
  Synthetic Peptide
TQLSFLRGEKILI

SEQ ID NO: 3251 - protein, 13 aa, Artificial Sequence
  Synthetic Peptide
PIGRGQRELIIGD

SEQ ID NO: 3252 - protein, 13 aa, Artificial Sequence
  Synthetic Peptide
GGGGGGRGGRGRH

SEQ ID NO: 3253 - protein, 13 aa, Artificial Sequence
  Synthetic Peptide
GGGRGGRGRHPGH

SEQ ID NO: 3254 - protein, 13 aa, Artificial Sequence
  Synthetic Peptide
GRGGRGRHPGHLK

SEQ ID NO: 3255 - protein, 13 aa, Artificial Sequence
  Synthetic Peptide
SLTANLRLPMASA

SEQ ID NO: 3256 - protein, 13 aa, Artificial Sequence
  Synthetic Peptide
EIHKSFRGSNFTV

SEQ ID NO: 3257 - protein, 13 aa, Artificial Sequence
  Synthetic Peptide
NRRMSGRGVGSVS

SEQ ID NO: 3258 - protein, 13 aa, Artificial Sequence
  Synthetic Peptide
FAFYNPRLQGKSL

SEQ ID NO: 3259 - protein, 13 aa, Artificial Sequence
  Synthetic Peptide
RRRASCRPTTAAR

SEQ ID NO: 3260 - protein, 13 aa, Artificial Sequence
  Synthetic Peptide
GRSRSTRGGHMNS

SEQ ID NO: 3261 - protein, 13 aa, Artificial Sequence
  Synthetic Peptide
HTMHVGRGGDVFG

SEQ ID NO: 3262 - protein, 13 aa, Artificial Sequence
  Synthetic Peptide
TFLKKTRAGGVMK

SEQ ID NO: 3263 - protein, 13 aa, Artificial Sequence
  Synthetic Peptide
PPGVPRRPPAAPS

SEQ ID NO: 3264 - protein, 13 aa, Artificial Sequence
  Synthetic Peptide
PPESMGRGRDWNV

SEQ ID NO: 3265 - protein, 13 aa, Artificial Sequence
  Synthetic Peptide
ESMGRGRDWNVDL

SEQ ID NO: 3266 - protein, 13 aa, Artificial Sequence
  Synthetic Peptide
YPRGGVRPVTHQL

SEQ ID NO: 3267 - protein, 13 aa, Artificial Sequence
  Synthetic Peptide
YDPNRYRLHFERD

SEQ ID NO: 3268 - protein, 13 aa, Artificial Sequence
  Synthetic Peptide
  misc_feature (12)..(13): Xaa can be any naturally occurring amino acid
QHSQNPRFYHKXX

SEQ ID NO: 3269 - protein, 13 aa, Artificial Sequence
  Synthetic Peptide
GPWGGGRGLRADG

SEQ ID NO: 3270 - protein, 13 aa, Artificial Sequence
  Synthetic Peptide
CIQSQWRGYKQKK

SEQ ID NO: 3271 - protein, 13 aa, Artificial Sequence
  Synthetic Peptide
GGGGGPRLRGGER

SEQ ID NO: 3272 - protein, 13 aa, Artificial Sequence
  Synthetic Peptide
LSTKRGRGGGEAA

SEQ ID NO: 3273 - protein, 13 aa, Artificial Sequence
  Synthetic Peptide
RGSGQARGLSPMR

SEQ ID NO: 3274 - protein, 13 aa, Artificial Sequence
  Synthetic Peptide
LVTGAGRGHAGRI

SEQ ID NO: 3275 - protein, 13 aa, Artificial Sequence
  Synthetic Peptide
TARAGPRKRGGPA

SEQ ID NO: 3276 - protein, 13 aa, Artificial Sequence
  Synthetic Peptide
RAGPRKRGGPAGR

SEQ ID NO: 3277 - protein, 13 aa, Artificial Sequence
  Synthetic Peptide
SVPPSKRGTVGAG

SEQ ID NO: 3278 - protein, 13 aa, Artificial Sequence
  Synthetic Peptide
KGSKFGRGTGLTQ

SEQ ID NO: 3279 - protein, 13 aa, Artificial Sequence
  Synthetic Peptide
YTEVAKRGGQHTL

SEQ ID NO: 3280 - protein, 13 aa, Artificial Sequence
  Synthetic Peptide
STWASPRPLLNWS

SEQ ID NO: 3281 - protein, 13 aa, Artificial Sequence
  Synthetic Peptide
LCATKFRVTQPNT

SEQ ID NO: 3282 - protein, 13 aa, Artificial Sequence
  Synthetic Peptide
PGALAHRLPTTGY

SEQ ID NO: 3283 - protein, 13 aa, Artificial Sequence
  Synthetic Peptide
SRNHRSRVTVARG

SEQ ID NO: 3284 - protein, 13 aa, Artificial Sequence
  Synthetic Peptide
SRVTVARGSALEM

SEQ ID NO: 3285 - protein, 13 aa, Artificial Sequence
  Synthetic Peptide
QRSPRTRGLCSKG

SEQ ID NO: 3286 - protein, 13 aa, Artificial Sequence
  Synthetic Peptide
GVGSPRRGMAPAS

SEQ ID NO: 3287 - protein, 13 aa, Artificial Sequence
  Synthetic Peptide
FEPRPVRGPLLRS

SEQ ID NO: 3288 - protein, 13 aa, Artificial Sequence
  Synthetic Peptide
IQELFKRVSEQFT

SEQ ID NO: 3289 - protein, 13 aa, Artificial Sequence
  Synthetic Peptide
LPLGSPRIPLPAQ

SEQ ID NO: 3290 - protein, 13 aa, Artificial Sequence
  Synthetic Peptide
RLASSSRGPPPRA

SEQ ID NO: 3291 - protein, 13 aa, Artificial Sequence
  Synthetic Peptide
RTGRSIRGFCLPP

SEQ ID NO: 3292 - protein, 13 aa, Artificial Sequence
  Synthetic Peptide
MGLEAPRGGRRRQ

SEQ ID NO: 3293 - protein, 13 aa, Artificial Sequence
  Synthetic Peptide
FRPTIQRGQWPPG

SEQ ID NO: 3294 - protein, 13 aa, Artificial Sequence
  Synthetic Peptide
ASSRHSRGPPPRA

SEQ ID NO: 3295 - protein, 13 aa, Artificial Sequence
  Synthetic Peptide
SCSLAGRGVSSRS

SEQ ID NO: 3296 - protein, 13 aa, Artificial Sequence
  Synthetic Peptide
IKIQKGRGHEEET

SEQ ID NO: 3297 - protein, 13 aa, Artificial Sequence
  Synthetic Peptide
VVVSGGRGLKSGE

SEQ ID NO: 3298 - protein, 13 aa, Artificial Sequence
  Synthetic Peptide
AVTPWPRGRLLTA

SEQ ID NO: 3299 - protein, 13 aa, Artificial Sequence
  Synthetic Peptide
SPTICRRGGTWFA

SEQ ID NO: 3300 - protein, 13 aa, Artificial Sequence
  Synthetic Peptide
MAATARRGWGAAA

SEQ ID NO: 3301 - protein, 13 aa, Artificial Sequence
  Synthetic Peptide
KSGRLLRGTANRL

SEQ ID NO: 3302 - protein, 13 aa, Artificial Sequence
  Synthetic Peptide
DLLRAGRGKPGAE

SEQ ID NO: 3303 - protein, 13 aa, Artificial Sequence
  Synthetic Peptide
QVLAGGRGKGTFE

SEQ ID NO: 3304 - protein, 13 aa, Artificial Sequence
  Synthetic Peptide
TARQEPRLVLISL

SEQ ID NO: 3305 - protein, 13 aa, Artificial Sequence
  Synthetic Peptide
SSFVTVRVKTPRR

SEQ ID NO: 3306 - protein, 13 aa, Artificial Sequence
  Synthetic Peptide
DVLGVWRRDQRPG

SEQ ID NO: 3307 - protein, 13 aa, Artificial Sequence
  Synthetic Peptide
QREGHGRGRGRPE

SEQ ID NO: 3308 - protein, 13 aa, Artificial Sequence
  Synthetic Peptide
EGHGRGRGRPEVI

SEQ ID NO: 3309 - protein, 13 aa, Artificial Sequence
  Synthetic Peptide
HGRGRGRPEVIQS

SEQ ID NO: 3310 - protein, 13 aa, Artificial Sequence
  Synthetic Peptide
RTLMAPRMISEGD

SEQ ID NO: 3311 - protein, 13 aa, Artificial Sequence
  Synthetic Peptide
PLEKAARARTAKD

SEQ ID NO: 3312 - protein, 13 aa, Artificial Sequence
  Synthetic Peptide
LLEQFARGVGLRS

SEQ ID NO: 3313 - protein, 13 aa, Artificial Sequence
  Synthetic Peptide
SYIPQSRLRYTPH

SEQ ID NO: 3314 - protein, 13 aa, Artificial Sequence
  Synthetic Peptide
NQMSIGRGKLPAE

SEQ ID NO: 3315 - protein, 13 aa, Artificial Sequence
  Synthetic Peptide
DGVGAPRLPLPYG

SEQ ID NO: 3316 - protein, 13 aa, Artificial Sequence
  Synthetic Peptide
LGRLPSRPPLPGS

SEQ ID NO: 3317 - protein, 13 aa, Artificial Sequence
  Synthetic Peptide
GGPVGPRLLGPPP

SEQ ID NO: 3318 - protein, 13 aa, Artificial Sequence
  Synthetic Peptide
GPGDPMRGGPMRG

SEQ ID NO: 3319 - protein, 13 aa, Artificial Sequence
  Synthetic Peptide
MRGGPMRGGPGPG

SEQ ID NO: 3320 - protein, 13 aa, Artificial Sequence
  Synthetic Peptide
GPGPYHRGRGGRG

SEQ ID NO: 3321 - protein, 13 aa, Artificial Sequence
  Synthetic Peptide
GPYHRGRGGRGGN

SEQ ID NO: 3322 - protein, 13 aa, Artificial Sequence
  Synthetic Peptide
HRGRGGRGGNEPP

SEQ ID NO: 3323 - protein, 13 aa, Artificial Sequence
  Synthetic Peptide
PPPPPFRGARGGR

SEQ ID NO: 3324 - protein, 13 aa, Artificial Sequence
  Synthetic Peptide
PPFRGARGGRSGG

SEQ ID NO: 3325 - protein, 13 aa, Artificial Sequence
  Synthetic Peptide
RGARGGRSGGGPP

SEQ ID NO: 3326 - protein, 13 aa, Artificial Sequence
  Synthetic Peptide
AGFPAPRIGPQPQ

SEQ ID NO: 3327 - protein, 13 aa, Artificial Sequence
  Synthetic Peptide
SLDSSLRGKQRMS

SEQ ID NO: 3328 - protein, 13 aa, Artificial Sequence
  Synthetic Peptide
HNGQGLRATRPSD

SEQ ID NO: 3329 - protein, 13 aa, Artificial Sequence
  Synthetic Peptide
QGLRATRPSDDPL

SEQ ID NO: 3330 - protein, 13 aa, Artificial Sequence
  Synthetic Peptide
LHPCQSRWVAGPW

SEQ ID NO: 3331 - protein, 13 aa, Artificial Sequence
  Synthetic Peptide
WGTVQLRGSWRVG

SEQ ID NO: 3332 - protein, 13 aa, Artificial Sequence
  Synthetic Peptide
WGLGCARPNKPGV

SEQ ID NO: 3333 - protein, 13 aa, Artificial Sequence
  Synthetic Peptide
KPGVYARVSRFVT

SEQ ID NO: 3334 - protein, 13 aa, Artificial Sequence
  Synthetic Peptide
KANAIGRGAKSVR

SEQ ID NO: 3335 - protein, 13 aa, Artificial Sequence
  Synthetic Peptide
  misc_feature (1)..(3): Xaa can be any naturally occurring amino acid
XXXMQRRGALFGM

SEQ ID NO: 3336 - protein, 13 aa, Artificial Sequence
  Synthetic Peptide
HYTSFIRHHKDQW

SEQ ID NO: 3337 - protein, 13 aa, Artificial Sequence
  Synthetic Peptide
GFCWNGRASISRS

SEQ ID NO: 3338 - protein, 13 aa, Artificial Sequence
  Synthetic Peptide
SVQTMQRGNMNCG

SEQ ID NO: 3339 - protein, 13 aa, Artificial Sequence
  Synthetic Peptide
LAQNAARIPGIPR

SEQ ID NO: 3340 - protein, 13 aa, Artificial Sequence
  Synthetic Peptide
RIPGIPRHSGPQY

SEQ ID NO: 3341 - protein, 13 aa, Artificial Sequence
  Synthetic Peptide
PFKSTARFTLNPN

SEQ ID NO: 3342 - protein, 13 aa, Artificial Sequence
  Synthetic Peptide
PYLYTPRYYPGGS

SEQ ID NO: 3343 - protein, 13 aa, Artificial Sequence
  Synthetic Peptide
KVKQGGRGAGATL

SEQ ID NO: 3344 - protein, 13 aa, Artificial Sequence
  Synthetic Peptide
QDLRFARVPLALH

SEQ ID NO: 3345 - protein, 13 aa, Artificial Sequence
  Synthetic Peptide
AYGKLYRGPTRVP

SEQ ID NO: 3346 - protein, 13 aa, Artificial Sequence
  Synthetic Peptide
AFQQPGRGKNRRQ

SEQ ID NO: 3347 - protein, 13 aa, Artificial Sequence
  Synthetic Peptide
RSGMVPRGPTATA

SEQ ID NO: 3348 - protein, 13 aa, Artificial Sequence
  Synthetic Peptide
GFGKVYRGSWRGE

SEQ ID NO: 3349 - protein, 13 aa, Artificial Sequence
  Synthetic Peptide
VALSRGRQLAAPP

SEQ ID NO: 3350 - protein, 13 aa, Artificial Sequence
  Synthetic Peptide
LVKPSGRGAAPSL

SEQ ID NO: 3351 - protein, 13 aa, Artificial Sequence
  Synthetic Peptide
PHVGNYRLLRTIG

SEQ ID NO: 3352 - protein, 13 aa, Artificial Sequence
  Synthetic Peptide
AMETRGRGTSQLA

SEQ ID NO: 3353 - protein, 13 aa, Artificial Sequence
  Synthetic Peptide
PLYHYGRGMNPAD

SEQ ID NO: 3354 - protein, 13 aa, Artificial Sequence
  Synthetic Peptide
ALAQAGRGEDRSP

SEQ ID NO: 3355 - protein, 13 aa, Artificial Sequence
  Synthetic Peptide
FLSRPARGLYSRS

SEQ ID NO: 3356 - protein, 13 aa, Artificial Sequence
  Synthetic Peptide
PSRPVPRSGAHWS

SEQ ID NO: 3357 - protein, 13 aa, Artificial Sequence
  Synthetic Peptide
GALLLLRNSPQPL

SEQ ID NO: 3358 - protein, 13 aa, Artificial Sequence
  Synthetic Peptide
SRNKYGRGSISLN

SEQ ID NO: 3359 - protein, 13 aa, Artificial Sequence
  Synthetic Peptide
SLNSSPRGRYSGK

SEQ ID NO: 3360 - protein, 13 aa, Artificial Sequence
  Synthetic Peptide
TPHPSPRGSPLPT

SEQ ID NO: 3361 - protein, 13 aa, Artificial Sequence
  Synthetic Peptide
MIRELCRGFGRYR

SEQ ID NO: 3362 - protein, 13 aa, Artificial Sequence
  Synthetic Peptide
IQAPGPRAGPCIL

SEQ ID NO: 3363 - protein, 13 aa, Artificial Sequence
  Synthetic Peptide
VPIYANRFAVPTY

SEQ ID NO: 3364 - protein, 13 aa, Artificial Sequence
  Synthetic Peptide
GCAYTYRPWTRGG

SEQ ID NO: 3365 - protein, 13 aa, Artificial Sequence
  Synthetic Peptide
TYRPWTRGGSLER

SEQ ID NO: 3366 - protein, 13 aa, Artificial Sequence
  Synthetic Peptide
RGGSLERSQSRKD

SEQ ID NO: 3367 - protein, 13 aa, Artificial Sequence
  Synthetic Peptide
LERSQSRKDSLDD

SEQ ID NO: 3368 - protein, 13 aa, Artificial Sequence
  Synthetic Peptide
YLYEIARRHPYFY

SEQ ID NO: 3369 - protein, 13 aa, Artificial Sequence
  Synthetic Peptide
LPTHRRRGSFSSE

SEQ ID NO: 3370 - protein, 13 aa, Artificial Sequence
  Synthetic Peptide
DKLVNERLISMAY

SEQ ID NO: 3371 - protein, 13 aa, Artificial Sequence
  Synthetic Peptide
KAQRPLRGAKTLS

SEQ ID NO: 3372 - protein, 13 aa, Artificial Sequence
  Synthetic Peptide
SVQNSERGKKIGN

SEQ ID NO: 3373 - protein, 13 aa, Artificial Sequence
  Synthetic Peptide
TFLLPSRPAQRGY

SEQ ID NO: 3374 - protein, 13 aa, Artificial Sequence
  Synthetic Peptide
  misc_feature (13)..(13): Xaa can be any naturally occurring amino acid
ELEGWGRGVYIRX

SEQ ID NO: 3375 - protein, 13 aa, Artificial Sequence
  Synthetic Peptide
QPYYNSRGVSRGG

SEQ ID NO: 3376 - protein, 13 aa, Artificial Sequence
  Synthetic Peptide
NSRGVSRGGSRGA

SEQ ID NO: 3377 - protein, 13 aa, Artificial Sequence
  Synthetic Peptide
VSRGGSRGARGLM

SEQ ID NO: 3378 - protein, 13 aa, Artificial Sequence
  Synthetic Peptide
GGSRGARGLMNGY

SEQ ID NO: 3379 - protein, 13 aa, Artificial Sequence
  Synthetic Peptide
GLMNGYRGPANGF

SEQ ID NO: 3380 - protein, 13 aa, Artificial Sequence
  Synthetic Peptide
DYSGYQRDGYQQN

SEQ ID NO: 3381 - protein, 13 aa, Artificial Sequence
  Synthetic Peptide
PSQSAVRGGPGRS

SEQ ID NO: 3382 - protein, 13 aa, Artificial Sequence
  Synthetic Peptide
AFGRGSRGPGNPL

SEQ ID NO: 3383 - protein, 13 aa, Artificial Sequence
  Synthetic Peptide
LPGGGGRGSRGPG

SEQ ID NO: 3384 - protein, 13 aa, Artificial Sequence
  Synthetic Peptide
GGGRGSRGPGNPL

SEQ ID NO: 3385 - protein, 13 aa, Artificial Sequence
  Synthetic Peptide
PPLAPIRGPLFPV

SEQ ID NO: 3386 - protein, 13 aa, Artificial Sequence
  Synthetic Peptide
RGPFLRRGPPFPP

SEQ ID NO: 3387 - protein, 13 aa, Artificial Sequence
  Synthetic Peptide
LFPVDARGPFLRR

SEQ ID NO: 3388 - protein, 13 aa, Artificial Sequence
  Synthetic Peptide
RWLPSRRGGVSGF

SEQ ID NO: 3389 - protein, 13 aa, Artificial Sequence
  Synthetic Peptide
GGGKLPRGSWRSS

SEQ ID NO: 3390 - protein, 13 aa, Artificial Sequence
  Synthetic Peptide
SPRTQGRGGPASV

SEQ ID NO: 3391 - protein, 13 aa, Artificial Sequence
  Synthetic Peptide
SVILNPRALQPST

SEQ ID NO: 3392 - protein, 13 aa, Artificial Sequence
  Synthetic Peptide
QPGTVVRMQGLAY

SEQ ID NO: 3393 - protein, 13 aa, Artificial Sequence
  Synthetic Peptide
PASAYPRHFGPVP

SEQ ID NO: 3394 - protein, 13 aa, Artificial Sequence
  Synthetic Peptide
AGSRRGRGGRGPF

SEQ ID NO: 3395 - protein, 13 aa, Artificial Sequence
  Synthetic Peptide
RRGRGGRGPFPLQ

SEQ ID NO: 3396 - protein, 13 aa, Artificial Sequence
  Synthetic Peptide
PARGRPRGVISTP

SEQ ID NO: 3397 - protein, 13 aa, Artificial Sequence
  Synthetic Peptide
LPHGMGRGLLTRR

SEQ ID NO: 3398 - protein, 13 aa, Artificial Sequence
  Synthetic Peptide
IKRGGNRFEPYAN

SEQ ID NO: 3399 - protein, 13 aa, Artificial Sequence
  Synthetic Peptide
MGFGLERMAAPID

SEQ ID NO: 3400 - protein, 13 aa, Artificial Sequence
  Synthetic Peptide
AAPRAGRGAGWSL

SEQ ID NO: 3401 - protein, 13 aa, Artificial Sequence
  Synthetic Peptide
TSQSSGRGSASFL

SEQ ID NO: 3402 - protein, 13 aa, Artificial Sequence
  Synthetic Peptide
RGAHMDRGRGRAQ

SEQ ID NO: 3403 - protein, 13 aa, Artificial Sequence
  Synthetic Peptide
RPVRLNRPRGGTL

SEQ ID NO: 3404 - protein, 13 aa, Artificial Sequence
  Synthetic Peptide
GAGAGARGGAAAG

SEQ ID NO: 3405 - protein, 13 aa, Artificial Sequence
  Synthetic Peptide
SKPRTARGGGLSL

SEQ ID NO: 3406 - protein, 13 aa, Artificial Sequence
  Synthetic Peptide
VPLDWARLPPPAP

SEQ ID NO: 3407 - protein, 13 aa, Artificial Sequence
  Synthetic Peptide
RTPSSFRQPFTPT

SEQ ID NO: 3408 - protein, 13 aa, Artificial Sequence
  Synthetic Peptide
PGTGSRRGPLAGL

SEQ ID NO: 3409 - protein, 13 aa, Artificial Sequence
  Synthetic Peptide
LFSPVGRRSSLSS

SEQ ID NO: 3410 - protein, 13 aa, Artificial Sequence
  Synthetic Peptide
RSSLSSRGTPTRM

SEQ ID NO: 3411 - protein, 13 aa, Artificial Sequence
  Synthetic Peptide
GTSFSGRKIKTAV

SEQ ID NO: 3412 - protein, 13 aa, Artificial Sequence
  Synthetic Peptide
ANGAWDRHSHSSS

SEQ ID NO: 3413 - protein, 13 aa, Artificial Sequence
  Synthetic Peptide
GPGLGPRVGPLLV

SEQ ID NO: 3414 - protein, 13 aa, Artificial Sequence
  Synthetic Peptide
CGTLPNRFVITPR

SEQ ID NO: 3415 - protein, 13 aa, Artificial Sequence
  Synthetic Peptide
TAQAAPRIITGPA

SEQ ID NO: 3416 - protein, 13 aa, Artificial Sequence
  Synthetic Peptide
PPAGFVRAGNPAV

SEQ ID NO: 3417 - protein, 13 aa, Artificial Sequence
  Synthetic Peptide
VPLAAQRVLHPDE

SEQ ID NO: 3418 - protein, 13 aa, Artificial Sequence
  Synthetic Peptide
TQPGPGRGRKKDH

SEQ ID NO: 3419 - protein, 13 aa, Artificial Sequence
  Synthetic Peptide
LKELGERQVEKST

SEQ ID NO: 3420 - protein, 13 aa, Artificial Sequence
  Synthetic Peptide
HTRSVGRGSSLQV

SEQ ID NO: 3421 - protein, 13 aa, Artificial Sequence
  Synthetic Peptide
AQGPGGRGGGGGG

SEQ ID NO: 3422 - protein, 13 aa, Artificial Sequence
  Synthetic Peptide
LQRGVGRGAGGGE

SEQ ID NO: 3423 - protein, 13 aa, Artificial Sequence
  Synthetic Peptide
RYGTNNRIGQPRP

SEQ ID NO: 3424 - protein, 13 aa, Artificial Sequence
  Synthetic Peptide
PPPAASRGGLGGT

SEQ ID NO: 3425 - protein, 13 aa, Artificial Sequence
  Synthetic Peptide
RRRGHGRGGGLTG

SEQ ID NO: 3426 - protein, 13 aa, Artificial Sequence
  Synthetic Peptide
RTIGRSRGAIISQ

SEQ ID NO: 3427 - protein, 13 aa, Artificial Sequence
  Synthetic Peptide
EPRGGGRGALPTS

SEQ ID NO: 3428 - protein, 13 aa, Artificial Sequence
  Synthetic Peptide
RREARGRGDASGL

SEQ ID NO: 3429 - protein, 13 aa, Artificial Sequence
  Synthetic Peptide
QVAGVPRFRFGPP

SEQ ID NO: 3430 - protein, 13 aa, Artificial Sequence
  Synthetic Peptide
KPFRRVRLQTTLR

SEQ ID NO: 3431 - protein, 13 aa, Artificial Sequence
  Synthetic Peptide
RGRQFNRQRGVSH

SEQ ID NO: 3432 - protein, 13 aa, Artificial Sequence
  Synthetic Peptide
RQFNRQRGVSHAM

SEQ ID NO: 3433 - protein, 13 aa, Artificial Sequence
  Synthetic Peptide
SHAMGGRGGINRG

SEQ ID NO: 3434 - protein, 13 aa, Artificial Sequence
  Synthetic Peptide
  misc_feature (12)..(13): Xaa can be any naturally occurring amino acid
GRGGINRGNINXX

SEQ ID NO: 3435 - protein, 13 aa, Artificial Sequence
  Synthetic Peptide
MEWSSRRSIFRMN

SEQ ID NO: 3436 - protein, 13 aa, Artificial Sequence
  Synthetic Peptide
SRRSIFRMNGDKF

SEQ ID NO: 3437 - protein, 13 aa, Artificial Sequence
  Synthetic Peptide
PPVPAGRLATPFT

SEQ ID NO: 3438 - protein, 13 aa, Artificial Sequence
  Synthetic Peptide
TATPGGRGDMKYG

SEQ ID NO: 3439 - protein, 13 aa, Artificial Sequence
  Synthetic Peptide
RFSLTERRHHCRN

SEQ ID NO: 3440 - protein, 13 aa, Artificial Sequence
  Synthetic Peptide
RSGRLFRPPSPAP

SEQ ID NO: 3441 - protein, 13 aa, Artificial Sequence
  Synthetic Peptide
PDGLRGRGVGSPE

SEQ ID NO: 3442 - protein, 13 aa, Artificial Sequence
  Synthetic Peptide
GATQGLRTGFTNI

SEQ ID NO: 3443 - protein, 13 aa, Artificial Sequence
  Synthetic Peptide
FTNIPSRYGTNNR

SEQ ID NO: 3444 - protein, 13 aa, Artificial Sequence
  Synthetic Peptide
LPNKTPRGSWRWS

SEQ ID NO: 3445 - protein, 13 aa, Artificial Sequence
  Synthetic Peptide
LLEGPLRLSPLLP

SEQ ID NO: 3446 - protein, 13 aa, Artificial Sequence
  Synthetic Peptide
IVDPLARGRAFRH

SEQ ID NO: 3447 - protein, 13 aa, Artificial Sequence
  Synthetic Peptide
TRFSLARQVDGDN

SEQ ID NO: 3448 - protein, 13 aa, Artificial Sequence
  Synthetic Peptide
GAGAGGRGGGRNR

SEQ ID NO: 3449 - protein, 13 aa, Artificial Sequence
  Synthetic Peptide
RESAPYRGMVRTA

SEQ ID NO: 3450 - protein, 13 aa, Artificial Sequence
  Synthetic Peptide
ATSGGGRPGLGRG

SEQ ID NO: 3451 - protein, 13 aa, Artificial Sequence
  Synthetic Peptide
PGLGRGRNSNKGL

SEQ ID NO: 3452 - protein, 13 aa, Artificial Sequence
  Synthetic Peptide
HRVSAGRGSISSG

SEQ ID NO: 3453 - protein, 13 aa, Artificial Sequence
  Synthetic Peptide
GGSGGGRGGASGP

SEQ ID NO: 3454 - protein, 13 aa, Artificial Sequence
  Synthetic Peptide
PSQRGGRTGALHL

SEQ ID NO: 3455 - protein, 13 aa, Artificial Sequence
  Synthetic Peptide
NRSRGYRGGSAGG

SEQ ID NO: 3456 - protein, 13 aa, Artificial Sequence
  Synthetic Peptide
GGSAGGRGFFRGG

SEQ ID NO: 3457 - protein, 13 aa, Artificial Sequence
  Synthetic Peptide
SRGGGDRGYGGNR

SEQ ID NO: 3458 - protein, 13 aa, Artificial Sequence
  Synthetic Peptide
RGYGGNRFESRSG

SEQ ID NO: 3459 - protein, 13 aa, Artificial Sequence
  Synthetic Peptide
GGYGGSRDYYSSR

SEQ ID NO: 3460 - protein, 13 aa, Artificial Sequence
  Synthetic Peptide
SRSPARRGGYGPR

SEQ ID NO: 3461 - protein, 13 aa, Artificial Sequence
  Synthetic Peptide
AFPQGGRGRGRFP

SEQ ID NO: 3462 - protein, 13 aa, Artificial Sequence
  Synthetic Peptide
PQGGRGRGRFPGA

SEQ ID NO: 3463 - protein, 13 aa, Artificial Sequence
  Synthetic Peptide
VPMQDPRAAMQRG

SEQ ID NO: 3464 - protein, 13 aa, Artificial Sequence
  Synthetic Peptide
PRAAMQRGSLPAN

SEQ ID NO: 3465 - protein, 13 aa, Artificial Sequence
  Synthetic Peptide
ANVPTPRGLLGDA

SEQ ID NO: 3466 - protein, 13 aa, Artificial Sequence
  Synthetic Peptide
TGEVEPRGYLGPP

SEQ ID NO: 3467 - protein, 13 aa, Artificial Sequence
  Synthetic Peptide
PLMAEPRGPMLDQ

SEQ ID NO: 3468 - protein, 13 aa, Artificial Sequence
  Synthetic Peptide
GPPLDGRGGRDPR

SEQ ID NO: 3469 - protein, 13 aa, Artificial Sequence
  Synthetic Peptide
VQMSDPRAPIPRG

SEQ ID NO: 3470 - protein, 13 aa, Artificial Sequence
  Synthetic Peptide
LLIGEPRGPMIDQ

SEQ ID NO: 3471 - protein, 13 aa, Artificial Sequence
  Synthetic Peptide
ARGLEMRGPVPSS

SEQ ID NO: 3472 - protein, 13 aa, Artificial Sequence
  Synthetic Peptide
LLDGLNRGRPRLA

SEQ ID NO: 3473 - protein, 13 aa, Artificial Sequence
  Synthetic Peptide
FKDFQRRILVATN

SEQ ID NO: 3474 - protein, 13 aa, Artificial Sequence
  Synthetic Peptide
LYHSPARRFGGPV

SEQ ID NO: 3475 - protein, 13 aa, Artificial Sequence
  Synthetic Peptide
QSGALVRMQGVPY

SEQ ID NO: 3476 - protein, 13 aa, Artificial Sequence
  Synthetic Peptide
  misc_feature (1)..(1): Xaa can be any naturally occurring amino acid
XMAPPVRYCIPGE

SEQ ID NO: 3477 - protein, 13 aa, Artificial Sequence
  Synthetic Peptide
PAALRGRLLCDFR

SEQ ID NO: 3478 - protein, 13 aa, Artificial Sequence
  Synthetic Peptide
GGNQRNRGNRLQD

SEQ ID NO: 3479 - protein, 13 aa, Artificial Sequence
  Synthetic Peptide
QRNRGNRLQDNRQ

SEQ ID NO: 3480 - protein, 13 aa, Artificial Sequence
  Synthetic Peptide
FRGRDNRWGWPSD

SEQ ID NO: 3481 - protein, 13 aa, Artificial Sequence
  Synthetic Peptide
GWPSDNRSNQWHG

SEQ ID NO: 3482 - protein, 13 aa, Artificial Sequence
  Synthetic Peptide
SNQWHGRSWGNNY

SEQ ID NO: 3483 - protein, 13 aa, Artificial Sequence
  Synthetic Peptide
HYGYNQRPPYGYY

SEQ ID NO: 3484 - protein, 13 aa, Artificial Sequence
  Synthetic Peptide
RPPGSGRGSGGSD

SEQ ID NO: 3485 - protein, 13 aa, Artificial Sequence
  Synthetic Peptide
GGSYGGRGRGRRT

SEQ ID NO: 3486 - protein, 13 aa, Artificial Sequence
  Synthetic Peptide
SYGGRGRGRRTGG

SEQ ID NO: 3487 - protein, 13 aa, Artificial Sequence
  Synthetic Peptide
GGRGRGRRTGGPA

SEQ ID NO: 3488 - protein, 13 aa, Artificial Sequence
  Synthetic Peptide
KQSGKKRGFGFVY

SEQ ID NO: 3489 - protein, 13 aa, Artificial Sequence
  Synthetic Peptide
GGGGGSRSSRGGR

SEQ ID NO: 3490 - protein, 13 aa, Artificial Sequence
  Synthetic Peptide
GSSWGGRSNSGPY

SEQ ID NO: 3491 - protein, 13 aa, Artificial Sequence
  Synthetic Peptide
QYFAKPRNQGGYG

SEQ ID NO: 3492 - protein, 13 aa, Artificial Sequence
  Synthetic Peptide
  misc_feature (10)..(13): Xaa can be any naturally occurring amino acid
SSYGSGRRFXXXX

SEQ ID NO: 3493 - protein, 13 aa, Artificial Sequence
  Synthetic Peptide
GPGSNFRGGSDGY

SEQ ID NO: 3494 - protein, 13 aa, Artificial Sequence
  Synthetic Peptide
DGYGSGRGFGDGY

SEQ ID NO: 3495 - protein, 13 aa, Artificial Sequence
  Synthetic Peptide
GNFGGSRNMGGPY

SEQ ID NO: 3496 - protein, 13 aa, Artificial Sequence
  Synthetic Peptide
  misc_feature (11)..(13): Xaa can be any naturally occurring amino acid
SGGYGGRSRYXXX

SEQ ID NO: 3497 - protein, 13 aa, Artificial Sequence
  Synthetic Peptide
PQTKRSRGFGFVT

SEQ ID NO: 3498 - protein, 13 aa, Artificial Sequence
  Synthetic Peptide
QSAGSQRGRGGGS

SEQ ID NO: 3499 - protein, 13 aa, Artificial Sequence
  Synthetic Peptide
AGSQRGRGGGSGN

SEQ ID NO: 3500 - protein, 13 aa, Artificial Sequence
  Synthetic Peptide
GGGGGSRGSYGGG

SEQ ID NO: 3501 - protein, 13 aa, Artificial Sequence
  Synthetic Peptide
GGSFGGRSSGSPY

SEQ ID NO: 3502 - protein, 13 aa, Artificial Sequence
  Synthetic Peptide
  misc_feature (9)..(13): Xaa can be any naturally occurring amino acid
GGYGSRRFXXXXX

SEQ ID NO: 3503 - protein, 13 aa, Artificial Sequence
  Synthetic Peptide
SGGRGNRNRGNRG

SEQ ID NO: 3504 - protein, 13 aa, Artificial Sequence
  Synthetic Peptide
GRGNRNRGNRGSG

SEQ ID NO: 3505 - protein, 13 aa, Artificial Sequence
  Synthetic Peptide
NRNRGNRGSGGGG

SEQ ID NO: 3506 - protein, 13 aa, Artificial Sequence
  Synthetic Peptide
VPSKRQRVSGNTS

SEQ ID NO: 3507 - protein, 13 aa, Artificial Sequence
  Synthetic Peptide
RPGPYDRPGTARR

SEQ ID NO: 3508 - protein, 13 aa, Artificial Sequence
  Synthetic Peptide
DRPGTARRYIGIV

SEQ ID NO: 3509 - protein, 13 aa, Artificial Sequence
  Synthetic Peptide
IRFIYTREGRPSG

SEQ ID NO: 3510 - protein, 13 aa, Artificial Sequence
  Synthetic Peptide
RPGPYDRPGAGRG

SEQ ID NO: 3511 - protein, 13 aa, Artificial Sequence
  Synthetic Peptide
RGAGFERMRRGAY

SEQ ID NO: 3512 - protein, 13 aa, Artificial Sequence
  Synthetic Peptide
DRMRDGRGMGGHG

SEQ ID NO: 3513 - protein, 13 aa, Artificial Sequence
  Synthetic Peptide
  misc_feature (11)..(13): Xaa can be any naturally occurring amino acid
MSGGGWRGMYXXX

SEQ ID NO: 3514 - protein, 13 aa, Artificial Sequence
  Synthetic Peptide
FDDRRGRPVGFPM

SEQ ID NO: 3515 - protein, 13 aa, Artificial Sequence
  Synthetic Peptide
GRGGFDRMPPGRG

SEQ ID NO: 3516 - protein, 13 aa, Artificial Sequence
  Synthetic Peptide
YDDMSPRRGPPPP

SEQ ID NO: 3517 - protein, 13 aa, Artificial Sequence
  Synthetic Peptide
YEENRGRGYFEHR

SEQ ID NO: 3518 - protein, 13 aa, Artificial Sequence
  Synthetic Peptide
GPPGGNRGGFQNR

SEQ ID NO: 3519 - protein, 13 aa, Artificial Sequence
  Synthetic Peptide
RGGFQNRGGGSGG

SEQ ID NO: 3520 - protein, 13 aa, Artificial Sequence
  Synthetic Peptide
GGGGNYRGGFNRS

SEQ ID NO: 3521 - protein, 13 aa, Artificial Sequence
  Synthetic Peptide
YRGGFNRSGGGGY

SEQ ID NO: 3522 - protein, 13 aa, Artificial Sequence
  Synthetic Peptide
NNNSNNRGSYNRA

SEQ ID NO: 3523 - protein, 13 aa, Artificial Sequence
  Synthetic Peptide
YVGGQRRGYDNRA

SEQ ID NO: 3524 - protein, 13 aa, Artificial Sequence
  Synthetic Peptide
RRGYDNRAYGQQY

SEQ ID NO: 3525 - protein, 13 aa, Artificial Sequence
  Synthetic Peptide
YRNFYDRYRGDYD

SEQ ID NO: 3526 - protein, 13 aa, Artificial Sequence
  Synthetic Peptide
NFYDRYRGDYDRF

SEQ ID NO: 3527 - protein, 13 aa, Artificial Sequence
  Synthetic Peptide
YYRQYNRDWQSYY

SEQ ID NO: 3528 - protein, 13 aa, Artificial Sequence
  Synthetic Peptide
DRDRYYRNYYGYQ

SEQ ID NO: 3529 - protein, 13 aa, Artificial Sequence
  Synthetic Peptide
  misc_feature (8)..(13): Xaa can be any naturally occurring amino acid
YGYQGYRXXXXXX

SEQ ID NO: 3530 - protein, 13 aa, Artificial Sequence
  Synthetic Peptide
GAAAGGRGGTRGR

SEQ ID NO: 3531 - protein, 13 aa, Artificial Sequence
  Synthetic Peptide
GVPEPSRGRGVPV

SEQ ID NO: 3532 - protein, 13 aa, Artificial Sequence
  Synthetic Peptide
PEPSRGRGVPVRG

SEQ ID NO: 3533 - protein, 13 aa, Artificial Sequence
  Synthetic Peptide
  misc_feature (9)..(13): Xaa can be any naturally occurring amino acid
REHPYGRYXXXXX

SEQ ID NO: 3534 - protein, 13 aa, Artificial Sequence
  Synthetic Peptide
GMPPGGRGRGRGQ

SEQ ID NO: 3535 - protein, 13 aa, Artificial Sequence
  Synthetic Peptide
SQKISSRGGFSGN

SEQ ID NO: 3536 - protein, 13 aa, Artificial Sequence
  Synthetic Peptide
GGFSGNRGGRGAF

SEQ ID NO: 3537 - protein, 13 aa, Artificial Sequence
  Synthetic Peptide
SGNRGGRGAFHSQ

SEQ ID NO: 3538 - protein, 13 aa, Artificial Sequence
  Synthetic Peptide
SRREGTRGSSWSA

SEQ ID NO: 3539 - protein, 13 aa, Artificial Sequence
  Synthetic Peptide
PRDRASRGRGGLG

SEQ ID NO: 3540 - protein, 13 aa, Artificial Sequence
  Synthetic Peptide
DRASRGRGGLGPS

SEQ ID NO: 3541 - protein, 13 aa, Artificial Sequence
  Synthetic Peptide
SGSGGSRGKFVSG

SEQ ID NO: 3542 - protein, 13 aa, Artificial Sequence
  Synthetic Peptide
  misc_feature (12)..(13): Xaa can be any naturally occurring amino acid
GRGRHVRSFTRXX

SEQ ID NO: 3543 - protein, 13 aa, Artificial Sequence
  Synthetic Peptide
AAMNMGRPFQKNR

SEQ ID NO: 3544 - protein, 13 aa, Artificial Sequence
  Synthetic Peptide
QNGDYGRGRRTLF

SEQ ID NO: 3545 - protein, 13 aa, Artificial Sequence
  Synthetic Peptide
NRRTLFRGRRRRE

SEQ ID NO: 3546 - protein, 13 aa, Artificial Sequence
  Synthetic Peptide
GRRTLFRGRRRRE

SEQ ID NO: 3547 - protein, 13 aa, Artificial Sequence
  Synthetic Peptide
KDYSGFRGNIIPR

SEQ ID NO: 3548 - protein, 13 aa, Artificial Sequence
  Synthetic Peptide
RGNIIPRGAAGKI

SEQ ID NO: 3549 - protein, 13 aa, Artificial Sequence
  Synthetic Peptide
SPLTSLRQYPPRS

SEQ ID NO: 3550 - protein, 13 aa, Artificial Sequence
  Synthetic Peptide
PSKSHLRHAIPSA

SEQ ID NO: 3551 - protein, 13 aa, Artificial Sequence
  Synthetic Peptide
PGLGRGRKNSFGY

SEQ ID NO: 3552 - protein, 13 aa, Artificial Sequence
  Synthetic Peptide
QKQQKGRGMGGAG

SEQ ID NO: 3553 - protein, 13 aa, Artificial Sequence
  Synthetic Peptide
VFGGRGRGGIPGT

SEQ ID NO: 3554 - protein, 13 aa, Artificial Sequence
  Synthetic Peptide
IFNIGSRGPLPLS

SEQ ID NO: 3555 - protein, 13 aa, Artificial Sequence
  Synthetic Peptide
TGSARGRSRVMPY

SEQ ID NO: 3556 - protein, 13 aa, Artificial Sequence
  Synthetic Peptide
MFPPGTRGRARGL

SEQ ID NO: 3557 - protein, 13 aa, Artificial Sequence
  Synthetic Peptide
PPGTRGRARGLPY

SEQ ID NO: 3558 - protein, 13 aa, Artificial Sequence
  Synthetic Peptide
GTRGRARGLPYTM

SEQ ID NO: 3559 - protein, 13 aa, Artificial Sequence
  Synthetic Peptide
FVATYGRGYPGFA

SEQ ID NO: 3560 - protein, 13 aa, Artificial Sequence
  Synthetic Peptide
AAVAAARGSGSNP

SEQ ID NO: 3561 - protein, 13 aa, Artificial Sequence
  Synthetic Peptide
RNREFTRGFSRAR

SEQ ID NO: 3562 - protein, 13 aa, Artificial Sequence
  Synthetic Peptide
QDYDAGRGGYGKL

SEQ ID NO: 3563 - protein, 13 aa, Artificial Sequence
  Synthetic Peptide
STLGAGRRRLNPN

SEQ ID NO: 3564 - protein, 13 aa, Artificial Sequence
  Synthetic Peptide
GGVGGLRVPAPVT

SEQ ID NO: 3565 - protein, 13 aa, Artificial Sequence
  Synthetic Peptide
GPGGTSRGKPAVG

SEQ ID NO: 3566 - protein, 13 aa, Artificial Sequence
  Synthetic Peptide
TTRPNRRGDTWHD

SEQ ID NO: 3567 - protein, 13 aa, Artificial Sequence
  Synthetic Peptide
TNQYMQRMASVRA

SEQ ID NO: 3568 - protein, 13 aa, Artificial Sequence
  Synthetic Peptide
WTAQGARPHPFQN

SEQ ID NO: 3569 - protein, 13 aa, Artificial Sequence
  Synthetic Peptide
KYAAGVRNPQQHL

SEQ ID NO: 3570 - protein, 13 aa, Artificial Sequence
  Synthetic Peptide
SQIARLRPSPRWT

SEQ ID NO: 3571 - protein, 13 aa, Artificial Sequence
  Synthetic Peptide
RLRPSPRWTAQGA

SEQ ID NO: 3572 - protein, 13 aa, Artificial Sequence
  Synthetic Peptide
VPQAQGRPPYYTP

SEQ ID NO: 3573 - protein, 13 aa, Artificial Sequence
  Synthetic Peptide
NQLAQMRPNPRWQ

SEQ ID NO: 3574 - protein, 13 aa, Artificial Sequence
  Synthetic Peptide
QMRPNPRWQQGGR

SEQ ID NO: 3575 - protein, 13 aa, Artificial Sequence
  Synthetic Peptide
IRQSGPRPTLRHL

SEQ ID NO: 3576 - protein, 13 aa, Artificial Sequence
  Synthetic Peptide
SPLFRGRKRLSDE

SEQ ID NO: 3577 - protein, 13 aa, Artificial Sequence
  Synthetic Peptide
GGGGPLRFEGPQG

SEQ ID NO: 3578 - protein, 13 aa, Artificial Sequence
  Synthetic Peptide
EGSPGLRFEGSPG

SEQ ID NO: 3579 - protein, 13 aa, Artificial Sequence
  Synthetic Peptide
GSPGGLRFEGPGG

SEQ ID NO: 3580 - protein, 13 aa, Artificial Sequence
  Synthetic Peptide
LRFDNPRGQPVGG

SEQ ID NO: 3581 - protein, 13 aa, Artificial Sequence
  Synthetic Peptide
PSGAAIRFDGPHG

SEQ ID NO: 3582 - protein, 13 aa, Artificial Sequence
  Synthetic Peptide
QPGGGIRFEGPLL

SEQ ID NO: 3583 - protein, 13 aa, Artificial Sequence
  Synthetic Peptide
QQGVGMRFEGPHG

SEQ ID NO: 3584 - protein, 13 aa, Artificial Sequence
  Synthetic Peptide
QLGGNLRFEGPHG

SEQ ID NO: 3585 - protein, 13 aa, Artificial Sequence
  Synthetic Peptide
QPGVGIRFEGPLV

SEQ ID NO: 3586 - protein, 13 aa, Artificial Sequence
  Synthetic Peptide
QQGGGMRFEGPSV

SEQ ID NO: 3587 - protein, 13 aa, Artificial Sequence
  Synthetic Peptide
QPSLLPRFDGLHG

SEQ ID NO: 3588 - protein, 13 aa, Artificial Sequence
  Synthetic Peptide
GQPGPQRFDGPPG

SEQ ID NO: 3589 - protein, 13 aa, Artificial Sequence
  Synthetic Peptide
GQQVQPRFDGVPQ

SEQ ID NO: 3590 - protein, 13 aa, Artificial Sequence
  Synthetic Peptide
FDGVPQRFDGPQH

SEQ ID NO: 3591 - protein, 13 aa, Artificial Sequence
  Synthetic Peptide
QHQQASRFDIPLG

SEQ ID NO: 3592 - protein, 13 aa, Artificial Sequence
  Synthetic Peptide
VGGVRSRVGIQQG

SEQ ID NO: 3593 - protein, 13 aa, Artificial Sequence
  Synthetic Peptide
QARRGPRGASRDG

SEQ ID NO: 3594 - protein, 13 aa, Artificial Sequence
  Synthetic Peptide
HHGHDPRGGLQPS

SEQ ID NO: 3595 - protein, 13 aa, Artificial Sequence
  Synthetic Peptide
GPQGPYRYPTPDG

SEQ ID NO: 3596 - protein, 13 aa, Artificial Sequence
  Synthetic Peptide
TPDGPSRFPRVAG

SEQ ID NO: 3597 - protein, 13 aa, Artificial Sequence
  Synthetic Peptide
GPSRFPRVAGPRG

SEQ ID NO: 3598 - protein, 13 aa, Artificial Sequence
  Synthetic Peptide
PRVAGPRGSGPPM

SEQ ID NO: 3599 - protein, 13 aa, Artificial Sequence
  Synthetic Peptide
GSGPPMRLVEPVG

SEQ ID NO: 3600 - protein, 13 aa, Artificial Sequence
  Synthetic Peptide
PMNFDPRWMMIPP

SEQ ID NO: 3601 - protein, 13 aa, Artificial Sequence
  Synthetic Peptide
FRGDDGRGGGTGG

SEQ ID NO: 3602 - protein, 13 aa, Artificial Sequence
  Synthetic Peptide
GRVFTPRGVPSRR

SEQ ID NO: 3603 - protein, 13 aa, Artificial Sequence
  Synthetic Peptide
GRTGPGRGDKRSW

SEQ ID NO: 3604 - protein, 13 aa, Artificial Sequence
  Synthetic Peptide
GLGAPVRLMAPTP

SEQ ID NO: 3605 - protein, 13 aa, Artificial Sequence
  Synthetic Peptide
FPPSRLRYNRSDI

SEQ ID NO: 3606 - protein, 13 aa, Artificial Sequence
  Synthetic Peptide
YRLFDYRGRLSPV

SEQ ID NO: 3607 - protein, 13 aa, Artificial Sequence
  Synthetic Peptide
DRLFDYRGRLSPV

SEQ ID NO: 3608 - protein, 13 aa, Artificial Sequence
  Synthetic Peptide
SPVPVPRAVPVKR

SEQ ID NO: 3609 - protein, 13 aa, Artificial Sequence
  Synthetic Peptide
PAPVGLRGSGLRG

SEQ ID NO: 3610 - protein, 13 aa, Artificial Sequence
  Synthetic Peptide
LRGSGLRGLQKDS

SEQ ID NO: 3611 - protein, 13 aa, Artificial Sequence
  Synthetic Peptide
EAQTRVRGSGLGA

SEQ ID NO: 3612 - protein, 13 aa, Artificial Sequence
  Synthetic Peptide
GSGLGARGSSYGV

SEQ ID NO: 3613 - protein, 13 aa, Artificial Sequence
  Synthetic Peptide
GILSSGRGRGIHS

SEQ ID NO: 3614 - protein, 13 aa, Artificial Sequence
  Synthetic Peptide
LSSGRGRGIHSRG

SEQ ID NO: 3615 - protein, 13 aa, Artificial Sequence
  Synthetic Peptide
RGRGRGRGVPGHA

SEQ ID NO: 3616 - protein, 13 aa, Artificial Sequence
  Synthetic Peptide
PPLLAARLVPPRN

SEQ ID NO: 3617 - protein, 13 aa, Artificial Sequence
  Synthetic Peptide
HAGKSARGTRGGG

SEQ ID NO: 3618 - protein, 13 aa, Artificial Sequence
  Synthetic Peptide
KSARGTRGGGFGA

SEQ ID NO: 3619 - protein, 13 aa, Artificial Sequence
  Synthetic Peptide
GFGAHGRGRSYSR

SEQ ID NO: 3620 - protein, 13 aa, Artificial Sequence
  Synthetic Peptide
GAHGRGRSYSRGG

SEQ ID NO: 3621 - protein, 13 aa, Artificial Sequence
  Synthetic Peptide
GRYYDSRPGGYGY

SEQ ID NO: 3622 - protein, 13 aa, Artificial Sequence
  Synthetic Peptide
YGYGYGRSRDYNG

SEQ ID NO: 3623 - protein, 13 aa, Artificial Sequence
  Synthetic Peptide
SRRGGRRGGPLMC

SEQ ID NO: 3624 - protein, 13 aa, Artificial Sequence
  Synthetic Peptide
GGPLMCRGVGDQR

SEQ ID NO: 3625 - protein, 13 aa, Artificial Sequence
  Synthetic Peptide
PLQDQWRAPPPPQ

SEQ ID NO: 3626 - protein, 13 aa, Artificial Sequence
  Synthetic Peptide
MSQPQFRPHVQTA

SEQ ID NO: 3627 - protein, 13 aa, Artificial Sequence
  Synthetic Peptide
PQASSSRMQCPQR

SEQ ID NO: 3628 - protein, 13 aa, Artificial Sequence
  Synthetic Peptide
RMQCPQRQGLRHN

SEQ ID NO: 3629 - protein, 13 aa, Artificial Sequence
  Synthetic Peptide
PQRQGLRHNTTSQ

SEQ ID NO: 3630 - protein, 13 aa, Artificial Sequence
  Synthetic Peptide
RKVTLTRGGLQQP

SEQ ID NO: 3631 - protein, 13 aa, Artificial Sequence
  Synthetic Peptide
IMHGRGRGVAGPM

SEQ ID NO: 3632 - protein, 13 aa, Artificial Sequence
  Synthetic Peptide
VAGPMGRGRLMPN

SEQ ID NO: 3633 - protein, 13 aa, Artificial Sequence
  Synthetic Peptide
GPMGRGRLMPNKQ

SEQ ID NO: 3634 - protein, 13 aa, Artificial Sequence
  Synthetic Peptide
REAMFLRRAAVAP

SEQ ID NO: 3635 - protein, 13 aa, Artificial Sequence
  Synthetic Peptide
AAVAPQRAPILRP

SEQ ID NO: 3636 - protein, 13 aa, Artificial Sequence
  Synthetic Peptide
VPHVLQRADSALS

SEQ ID NO: 3637 - protein, 13 aa, Artificial Sequence
  Synthetic Peptide
SAAAGPRPMALRP

SEQ ID NO: 3638 - protein, 13 aa, Artificial Sequence
  Synthetic Peptide
RYQKAARGGGAAE

SEQ ID NO: 3639 - protein, 13 aa, Artificial Sequence
  Synthetic Peptide
AGSIRGRGRGAAG

SEQ ID NO: 3640 - protein, 13 aa, Artificial Sequence
  Synthetic Peptide
SIRGRGRGAAGNR

SEQ ID NO: 3641 - protein, 13 aa, Artificial Sequence
  Synthetic Peptide
NRAPGPRGSYLGG

SEQ ID NO: 3642 - protein, 13 aa, Artificial Sequence
  Synthetic Peptide
GGYSAGRGIYSRY

SEQ ID NO: 3643 - protein, 13 aa, Artificial Sequence
  Synthetic Peptide
GRGIYSRYHEGKG

SEQ ID NO: 3644 - protein, 13 aa, Artificial Sequence
  Synthetic Peptide
TPHSDFRGRHRSR

SEQ ID NO: 3645 - protein, 13 aa, Artificial Sequence
  Synthetic Peptide
VMNSALRQMSYGG

SEQ ID NO: 3646 - protein, 13 aa, Artificial Sequence
  Synthetic Peptide
SSQRKVRMNSYPY

SEQ ID NO: 3647 - protein, 13 aa, Artificial Sequence
  Synthetic Peptide
GPPPPPRSRGPPR

SEQ ID NO: 3648 - protein, 13 aa, Artificial Sequence
  Synthetic Peptide
FNMSSSRGPLPVK

SEQ ID NO: 3649 - protein, 13 aa, Artificial Sequence
  Synthetic Peptide
GPLPVKRGPPPRS

SEQ ID NO: 3650 - protein, 13 aa, Artificial Sequence
  Synthetic Peptide
KRGPPPRSGGPPP

SEQ ID NO: 3651 - protein, 13 aa, Artificial Sequence
  Synthetic Peptide
RSAPPTRGPPPSY

SEQ ID NO: 3652 - protein, 13 aa, Artificial Sequence
  Synthetic Peptide
SYSSSSRGAPRGG

SEQ ID NO: 3653 - protein, 13 aa, Artificial Sequence
  Synthetic Peptide
PLNVGIRLPGRQT

SEQ ID NO: 3654 - protein, 13 aa, Artificial Sequence
  Synthetic Peptide
GIRLPGRQTNQRA

SEQ ID NO: 3655 - protein, 13 aa, Artificial Sequence
  Synthetic Peptide
TAAARKRGKPASG

SEQ ID NO: 3656 - protein, 13 aa, Artificial Sequence
  Synthetic Peptide
YRQQRNRGFGQSN

SEQ ID NO: 3657 - protein, 13 aa, Artificial Sequence
  Synthetic Peptide
SGTSNTRGSRRKP

SEQ ID NO: 3658 - protein, 13 aa, Artificial Sequence
  Synthetic Peptide
ASSWAVRKTLPAD

SEQ ID NO: 3659 - protein, 13 aa, Artificial Sequence
  Synthetic Peptide
LSIPNQRMPTMPM

SEQ ID NO: 3660 - protein, 13 aa, Artificial Sequence
  Synthetic Peptide
MPMLDIRPGLIPQ

SEQ ID NO: 3661 - protein, 13 aa, Artificial Sequence
  Synthetic Peptide
PQAPGPRFPLIQP

SEQ ID NO: 3662 - protein, 13 aa, Artificial Sequence
  Synthetic Peptide
EERGRFRSGNYRF

SEQ ID NO: 3663 - protein, 13 aa, Artificial Sequence
  Synthetic Peptide
RSGPWNRGFGQEV

SEQ ID NO: 3664 - protein, 13 aa, Artificial Sequence
  Synthetic Peptide
VARRHYRFIHGIG

SEQ ID NO: 3665 - protein, 13 aa, Artificial Sequence
  Synthetic Peptide
RHSGSDRSSFSHY

SEQ ID NO: 3666 - protein, 13 aa, Artificial Sequence
  Synthetic Peptide
RPGRGGRGGRGGR

SEQ ID NO: 3667 - protein, 13 aa, Artificial Sequence
  Synthetic Peptide
GLSPASRKRYDAA

SEQ ID NO: 3668 - protein, 13 aa, Artificial Sequence
  Synthetic Peptide
PAAAMARAMRVRT

SEQ ID NO: 3669 - protein, 13 aa, Artificial Sequence
  Synthetic Peptide
MGTPVPRPPQDMG

SEQ ID NO: 3670 - protein, 13 aa, Artificial Sequence
  Synthetic Peptide
MGQIGVRTPLGPR

SEQ ID NO: 3671 - protein, 13 aa, Artificial Sequence
  Synthetic Peptide
APVPRPRGPPPPP

SEQ ID NO: 3672 - protein, 13 aa, Artificial Sequence
  Synthetic Peptide
KYLQGKRGIEKPP

SEQ ID NO: 3673 - protein, 13 aa, Artificial Sequence
  Synthetic Peptide
AQPQDSRGGSKKY

SEQ ID NO: 3674 - protein, 13 aa, Artificial Sequence
  Synthetic Peptide
PPRPTPRPPVPPR

SEQ ID NO: 3675 - protein, 13 aa, Artificial Sequence
  Synthetic Peptide
RPPVPPRGPLRGP

SEQ ID NO: 3676 - protein, 13 aa, Artificial Sequence
  Synthetic Peptide
  misc_feature (13)..(13): Xaa can be any naturally occurring amino acid
PPRGPLRGPLPQX

SEQ ID NO: 3677 - protein, 13 aa, Artificial Sequence
  Synthetic Peptide
PPMPGPRLGPGKP

SEQ ID NO: 3678 - protein, 13 aa, Artificial Sequence
  Synthetic Peptide
VLVDVERGRTVKG

SEQ ID NO: 3679 - protein, 13 aa, Artificial Sequence
  Synthetic Peptide
PMTQAPRIMHHMP

SEQ ID NO: 3680 - protein, 13 aa, Artificial Sequence
  Synthetic Peptide
MPPPGMRPPPPGM

SEQ ID NO: 3681 - protein, 13 aa, Artificial Sequence
  Synthetic Peptide
  misc_feature (11)..(13): Xaa can be any naturally occurring amino acid
PPPPGMRGLLXXX

SEQ ID NO: 3682 - protein, 13 aa, Artificial Sequence
  Synthetic Peptide
TQYPPGRGTPPPP

SEQ ID NO: 3683 - protein, 13 aa, Artificial Sequence
  Synthetic Peptide
RNLSLVRGRRGER

SEQ ID NO: 3684 - protein, 13 aa, Artificial Sequence
  Synthetic Peptide
LSLVRGRRGERPD

SEQ ID NO: 3685 - protein, 13 aa, Artificial Sequence
  Synthetic Peptide
ISLGTARPPPSMS

SEQ ID NO: 3686 - protein, 13 aa, Artificial Sequence
  Synthetic Peptide
AAGLAARMSQVPA

SEQ ID NO: 3687 - protein, 13 aa, Artificial Sequence
  Synthetic Peptide
VPLMSLRTAPAAN

SEQ ID NO: 3688 - protein, 13 aa, Artificial Sequence
  Synthetic Peptide
AANLASRIPAASA

SEQ ID NO: 3689 - protein, 13 aa, Artificial Sequence
  Synthetic Peptide
MNLASARTPAIPT

SEQ ID NO: 3690 - protein, 13 aa, Artificial Sequence
  Synthetic Peptide
MNLASPRTAVAPS

SEQ ID NO: 3691 - protein, 13 aa, Artificial Sequence
  Synthetic Peptide
VNLADPRTPTAPA

SEQ ID NO: 3692 - protein, 13 aa, Artificial Sequence
  Synthetic Peptide
ANLVGPRSAHATA

SEQ ID NO: 3693 - protein, 13 aa, Artificial Sequence
  Synthetic Peptide
ANLTSPRVPLSAY

SEQ ID NO: 3694 - protein, 13 aa, Artificial Sequence
  Synthetic Peptide
GRERRSRGEYRDY

SEQ ID NO: 3695 - protein, 13 aa, Artificial Sequence
  Synthetic Peptide
APYGAGRGNYDAF

SEQ ID NO: 3696 - protein, 13 aa, Artificial Sequence
  Synthetic Peptide
GYPGKPRNRMVRG

SEQ ID NO: 3697 - protein, 13 aa, Artificial Sequence
  Synthetic Peptide
IDLKNRRGGPPFA

SEQ ID NO: 3698 - protein, 13 aa, Artificial Sequence
  Synthetic Peptide
DSHHSRRGPPPRR

SEQ ID NO: 3699 - protein, 13 aa, Artificial Sequence
  Synthetic Peptide
PPPSWGRRPRDDY

SEQ ID NO: 3700 - protein, 13 aa, Artificial Sequence
  Synthetic Peptide
GSYGSGRSGYGYR

SEQ ID NO: 3701 - protein, 13 aa, Artificial Sequence
  Synthetic Peptide
VTIEHARARSRGG

SEQ ID NO: 3702 - protein, 13 aa, Artificial Sequence
  Synthetic Peptide
RGRYSDRFSSRRP

SEQ ID NO: 3703 - protein, 13 aa, Artificial Sequence
  Synthetic Peptide
SRQGEPRGRSRGG

SEQ ID NO: 3704 - protein, 13 aa, Artificial Sequence
  Synthetic Peptide
EPRGRSRGGGYGR

SEQ ID NO: 3705 - protein, 13 aa, Artificial Sequence
  Synthetic Peptide
LRVEFPRTYGGRG

SEQ ID NO: 3706 - protein, 13 aa, Artificial Sequence
  Synthetic Peptide
PRTYGGRGGWPRG

SEQ ID NO: 3707 - protein, 13 aa, Artificial Sequence
  Synthetic Peptide
GRGGWPRGGRNGP

SEQ ID NO: 3708 - protein, 13 aa, Artificial Sequence
  Synthetic Peptide
DSPYQSRGSPHYF

SEQ ID NO: 3709 - protein, 13 aa, Artificial Sequence
  Synthetic Peptide
VQAVRGRGRGTLT

SEQ ID NO: 3710 - protein, 13 aa, Artificial Sequence
  Synthetic Peptide
  misc_feature (11)..(13): Xaa can be any naturally occurring amino acid
PLNNPRRPYYXXX

SEQ ID NO: 3711 - protein, 13 aa, Artificial Sequence
  Synthetic Peptide
GSQGGGRGRGGYD

SEQ ID NO: 3712 - protein, 13 aa, Artificial Sequence
  Synthetic Peptide
QGGGRGRGGYDKD

SEQ ID NO: 3713 - protein, 13 aa, Artificial Sequence
  Synthetic Peptide
RRPEFMRGGGSGG

SEQ ID NO: 3714 - protein, 13 aa, Artificial Sequence
  Synthetic Peptide
NQCNEPRPEDSRP

SEQ ID NO: 3715 - protein, 13 aa, Artificial Sequence
  Synthetic Peptide
PRPEDSRPSGGDF

SEQ ID NO: 3716 - protein, 13 aa, Artificial Sequence
  Synthetic Peptide
PSGGDFRGRGYGG

SEQ ID NO: 3717 - protein, 13 aa, Artificial Sequence
  Synthetic Peptide
GGDFRGRGYGGER

SEQ ID NO: 3718 - protein, 13 aa, Artificial Sequence
  Synthetic Peptide
GGYGGDRSGGGYG

SEQ ID NO: 3719 - protein, 13 aa, Artificial Sequence
  Synthetic Peptide
GGKMGGRNDYRND

SEQ ID NO: 3720 - protein, 13 aa, Artificial Sequence
  Synthetic Peptide
FFCTAGRGLEPFV

SEQ ID NO: 3721 - protein, 13 aa, Artificial Sequence
  Synthetic Peptide
GILAWGRGSGNNG

SEQ ID NO: 3722 - protein, 13 aa, Artificial Sequence
  Synthetic Peptide
QRTGRSRGFAFVY

SEQ ID NO: 3723 - protein, 13 aa, Artificial Sequence
  Synthetic Peptide
PGIYMGRPTYGSS

SEQ ID NO: 3724 - protein, 13 aa, Artificial Sequence
  Synthetic Peptide
TVGALPRGPRQNS

SEQ ID NO: 3725 - protein, 13 aa, Artificial Sequence
  Synthetic Peptide
SRHTLLRAPAPEL

SEQ ID NO: 3726 - protein, 13 aa, Artificial Sequence
  Synthetic Peptide
RSKPLTRGAKEEH

SEQ ID NO: 3727 - protein, 13 aa, Artificial Sequence
  Synthetic Peptide
LYQPGARSRNRLC

SEQ ID NO: 3728 - protein, 13 aa, Artificial Sequence
  Synthetic Peptide
IPGLVPRYAAPEQ

SEQ ID NO: 3729 - protein, 13 aa, Artificial Sequence
  Synthetic Peptide
GSIFIGRGSRRNP

SEQ ID NO: 3730 - protein, 13 aa, Artificial Sequence
  Synthetic Peptide
LDQAAFRTLGHVM

SEQ ID NO: 3731 - protein, 13 aa, Artificial Sequence
  Synthetic Peptide
KLMSNMRPQDSWR

SEQ ID NO: 3732 - protein, 13 aa, Artificial Sequence
  Synthetic Peptide
PLFQQQRFDRGVG

SEQ ID NO: 3733 - protein, 13 aa, Artificial Sequence
  Synthetic Peptide
QQQRFDRGVGAEP

SEQ ID NO: 3734 - protein, 13 aa, Artificial Sequence
  Synthetic Peptide
PGGYPPRRDDRGG

SEQ ID NO: 3735 - protein, 13 aa, Artificial Sequence
  Synthetic Peptide
GGYPPRRDDRGGR

SEQ ID NO: 3736 - protein, 13 aa, Artificial Sequence
  Synthetic Peptide
GRQGYPREGRKYP

SEQ ID NO: 3737 - protein, 13 aa, Artificial Sequence
  Synthetic Peptide
  misc_feature (12)..(13): Xaa can be any naturally occurring amino acid
LPPPSGRYNWNXX

SEQ ID NO: 3738 - protein, 13 aa, Artificial Sequence
  Synthetic Peptide
GRQVDIRGVPRGV

SEQ ID NO: 3739 - protein, 13 aa, Artificial Sequence
  Synthetic Peptide
DIRGVPRGVHLGS

SEQ ID NO: 3740 - protein, 13 aa, Artificial Sequence
  Synthetic Peptide
FQHPSPRGRSLPQ

SEQ ID NO: 3741 - protein, 13 aa, Artificial Sequence
  Synthetic Peptide
  misc_feature (10)..(13): Xaa can be any naturally occurring amino acid
QNGDYGRGRXXXX

SEQ ID NO: 3742 - protein, 13 aa, Artificial Sequence
  Synthetic Peptide
PATLASRSLSHWR

SEQ ID NO: 3743 - protein, 13 aa, Artificial Sequence
  Synthetic Peptide
GGYSQNRWGNNNR

SEQ ID NO: 3744 - protein, 13 aa, Artificial Sequence
  Synthetic Peptide
HSTFIGRAAAKNK

SEQ ID NO: 3745 - protein, 13 aa, Artificial Sequence
  Synthetic Peptide
KYASSVRSPHPAI

SEQ ID NO: 3746 - protein, 13 aa, Artificial Sequence
  Synthetic Peptide
SLSPTMRPGTGAE

SEQ ID NO: 3747 - protein, 13 aa, Artificial Sequence
  Synthetic Peptide
PGTGAERGGLMMG

SEQ ID NO: 3748 - protein, 13 aa, Artificial Sequence
  Synthetic Peptide
MHPMGQRANMPPV

SEQ ID NO: 3749 - protein, 13 aa, Artificial Sequence
  Synthetic Peptide
RANYNFRGMYNQR

SEQ ID NO: 3750 - protein, 13 aa, Artificial Sequence
  Synthetic Peptide
RGMYNQRYHCPVP

SEQ ID NO: 3751 - protein, 13 aa, Artificial Sequence
  Synthetic Peptide
GAEAKYRSASSAS

SEQ ID NO: 3752 - protein, 13 aa, Artificial Sequence
  Synthetic Peptide
DRPIIDRPIRGRG

SEQ ID NO: 3753 - protein, 13 aa, Artificial Sequence
  Synthetic Peptide
DRPIRGRGGLGRG

SEQ ID NO: 3754 - protein, 13 aa, Artificial Sequence
  Synthetic Peptide
GRGGRGRGMGRGD

SEQ ID NO: 3755 - protein, 13 aa, Artificial Sequence
  Synthetic Peptide
LKHEDKRGGSGSH

SEQ ID NO: 3756 - protein, 13 aa, Artificial Sequence
  Synthetic Peptide
NFGDLGRPGRGGR

SEQ ID NO: 3757 - protein, 13 aa, Artificial Sequence
  Synthetic Peptide
DLGRPGRGGRGGR

SEQ ID NO: 3758 - protein, 13 aa, Artificial Sequence
  Synthetic Peptide
PPGRGGRPMPPSR

SEQ ID NO: 3759 - protein, 13 aa, Artificial Sequence
  Synthetic Peptide
RPMPPSRRDYDDM

SEQ ID NO: 3760 - protein, 13 aa, Artificial Sequence
  Synthetic Peptide
DLMAYDRRGRPGD

SEQ ID NO: 3761 - protein, 13 aa, Artificial Sequence
  Synthetic Peptide
RGRPGDRYDGMVG

SEQ ID NO: 3762 - protein, 13 aa, Artificial Sequence
  Synthetic Peptide
IEIMTDRGSGKKR

SEQ ID NO: 3763 - protein, 13 aa, Artificial Sequence
  Synthetic Peptide
SASSSQRGRRGSG

SEQ ID NO: 3764 - protein, 13 aa, Artificial Sequence
  Synthetic Peptide
GGNFGGRSSGPYG

SEQ ID NO: 3765 - protein, 13 aa, Artificial Sequence
  Synthetic Peptide
GYDKDGRGPMTGS

SEQ ID NO: 3766 - protein, 13 aa, Artificial Sequence
  Synthetic Peptide
KVSFATRRPEFMR

SEQ ID NO: 3767 - protein, 13 aa, Artificial Sequence
  Synthetic Peptide
RGYGGERGYRGRG

SEQ ID NO: 3768 - protein, 13 aa, Artificial Sequence
  Synthetic Peptide
GGYGGDRSSGGGY

SEQ ID NO: 3769 - protein, 13 aa, Artificial Sequence
  Synthetic Peptide
GPGAAARGMKRES

SEQ ID NO: 3770 - protein, 13 aa, Artificial Sequence
  Synthetic Peptide
PPPPGMRGPPPPG

SEQ ID NO: 3771 - protein, 13 aa, Artificial Sequence
  Synthetic Peptide
SAVVMGRGRRRDD

SEQ ID NO: 3772 - protein, 13 aa, Artificial Sequence
  Synthetic Peptide
PPMPGPRLGPGKI

SEQ ID NO: 3773 - protein, 13 aa, Artificial Sequence
  Synthetic Peptide
MGYVPGRGLGKNA

SEQ ID NO: 3774 - protein, 13 aa, Artificial Sequence
  Synthetic Peptide
TAPRSVRGWGTQD

SEQ ID NO: 3775 - protein, 13 aa, Artificial Sequence
  Synthetic Peptide
PFYTQDRCATRRC

SEQ ID NO: 3776 - protein, 13 aa, Artificial Sequence
  Synthetic Peptide
PPPPIARAVVPSK

SEQ ID NO: 3777 - protein, 13 aa, Artificial Sequence
  Synthetic Peptide
GNVGGKRKADGYN

SEQ ID NO: 3778 - protein, 13 aa, Artificial Sequence
  Synthetic Peptide
FLQTYARGRTTYQ

SEQ ID NO: 3779 - protein, 13 aa, Artificial Sequence
  Synthetic Peptide
PWGRLHRSPLTFP

SEQ ID NO: 3780 - protein, 13 aa, Artificial Sequence
  Synthetic Peptide
TFPAWVRPPEAAR

SEQ ID NO: 3781 - protein, 13 aa, Artificial Sequence
  Synthetic Peptide
HPLLYSRLAPPPP

SEQ ID NO: 3782 - protein, 13 aa, Artificial Sequence
  Synthetic Peptide
HTVVTSRVVNRAN

SEQ ID NO: 3783 - protein, 13 aa, Artificial Sequence
  Synthetic Peptide
RVQPPRRGATPPA

SEQ ID NO: 3784 - protein, 13 aa, Artificial Sequence
  Synthetic Peptide
PPAGPRRAPPPAV

SEQ ID NO: 3785 - protein, 13 aa, Artificial Sequence
  Synthetic Peptide
EEEAAARGRLERT

SEQ ID NO: 3786 - protein, 13 aa, Artificial Sequence
  Synthetic Peptide
GRLERTRLGALAL

SEQ ID NO: 3787 - protein, 13 aa, Artificial Sequence
  Synthetic Peptide
QLAMVMRYGVNGV

SEQ ID NO: 3788 - protein, 13 aa, Artificial Sequence
  Synthetic Peptide
NAPKYGRGQLNYP

SEQ ID NO: 3789 - protein, 13 aa, Artificial Sequence
  Synthetic Peptide
YALSSPRGGTPGS

SEQ ID NO: 3790 - protein, 13 aa, Artificial Sequence
  Synthetic Peptide
DQMGKMRPQPYGG

SEQ ID NO: 3791 - protein, 13 aa, Artificial Sequence
  Synthetic Peptide
GSQTPQRYPMTMQ

SEQ ID NO: 3792 - protein, 13 aa, Artificial Sequence
  Synthetic Peptide
DPMVMKRPQLYGM

SEQ ID NO: 3793 - protein, 13 aa, Artificial Sequence
  Synthetic Peptide
GPPGPQRYPIGIQ

SEQ ID NO: 3794 - protein, 13 aa, Artificial Sequence
  Synthetic Peptide
TTESSCRGWTGAR

SEQ ID NO: 3795 - protein, 13 aa, Artificial Sequence
  Synthetic Peptide
GSRQIGRGYYVFD

SEQ ID NO: 3796 - protein, 13 aa, Artificial Sequence
  Synthetic Peptide
QDPMQLRGGPPFP

SEQ ID NO: 3797 - protein, 13 aa, Artificial Sequence
  Synthetic Peptide
PPFPGPRFPGNQI

SEQ ID NO: 3798 - protein, 13 aa, Artificial Sequence
  Synthetic Peptide
PGNQIQRVPGFGG

SEQ ID NO: 3799 - protein, 13 aa, Artificial Sequence
  Synthetic Peptide
VREELLRHQLLEK

SEQ ID NO: 3800 - protein, 13 aa, Artificial Sequence
  Synthetic Peptide
RDRMYSRDYRRDY

SEQ ID NO: 3801 - protein, 13 aa, Artificial Sequence
  Synthetic Peptide
PYGYRGRGRGYYQ

SEQ ID NO: 3802 - protein, 13 aa, Artificial Sequence
  Synthetic Peptide
GYRGRGRGYYQGG

SEQ ID NO: 3803 - protein, 13 aa, Artificial Sequence
  Synthetic Peptide
YQGGGGRYHRGGY

SEQ ID NO: 3804 - protein, 13 aa, Artificial Sequence
  Synthetic Peptide
GGGRYHRGGYRPV

SEQ ID NO: 3805 - protein, 13 aa, Artificial Sequence
  Synthetic Peptide
GFAGVSRPRGTFF

SEQ ID NO: 3806 - protein, 13 aa, Artificial Sequence
  Synthetic Peptide
AGVSRPRGTFFRI

SEQ ID NO: 3807 - protein, 13 aa, Artificial Sequence
  Synthetic Peptide
FTSFQPRTATVTI

SEQ ID NO: 3808 - protein, 13 aa, Artificial Sequence
  Synthetic Peptide
LGKAIIRTPVMVQ

SEQ ID NO: 3809 - protein, 13 aa, Artificial Sequence
  Synthetic Peptide
TATVTIRPNTSGS

SEQ ID NO: 3810 - protein, 13 aa, Artificial Sequence
  Synthetic Peptide
ITGPQIRPGMTVI

SEQ ID NO: 3811 - protein, 13 aa, Artificial Sequence
  Synthetic Peptide
PGMTVIRTPLQQS

SEQ ID NO: 3812 - protein, 13 aa, Artificial Sequence
  Synthetic Peptide
PAQADSRGRGRAR

SEQ ID NO: 3813 - protein, 13 aa, Artificial Sequence
  Synthetic Peptide
QADSRGRGRARGG

SEQ ID NO: 3814 - protein, 13 aa, Artificial Sequence
  Synthetic Peptide
DSRGRGRARGGCP

SEQ ID NO: 3815 - protein, 13 aa, Artificial Sequence
  Synthetic Peptide
RGRGRARGGCPGG

SEQ ID NO: 3816 - protein, 13 aa, Artificial Sequence
  Synthetic Peptide
MASSPGRGGISWQ

SEQ ID NO: 3817 - protein, 13 aa, Artificial Sequence
  Synthetic Peptide
PPGPPGRGAAAAR

SEQ ID NO: 3818 - protein, 13 aa, Artificial Sequence
  Synthetic Peptide
  misc_feature (8)..(13): Xaa can be any naturally occurring amino acid
GRAAWMRXXXXXX

SEQ ID NO: 3819 - protein, 13 aa, Artificial Sequence
  Synthetic Peptide
HKRKKSRSRSQSK

SEQ ID NO: 3820 - protein, 13 aa, Artificial Sequence
  Synthetic Peptide
RKKSRSRSQSKSR

SEQ ID NO: 3821 - protein, 13 aa, Artificial Sequence
  Synthetic Peptide
RAVLHTRPPRFQR

SEQ ID NO: 3822 - protein, 13 aa, Artificial Sequence
  Synthetic Peptide
LHTRPPRFQRDFV

SEQ ID NO: 3823 - protein, 13 aa, Artificial Sequence
  Synthetic Peptide
PPGLRPRFCAFGG

SEQ ID NO: 3824 - protein, 13 aa, Artificial Sequence
  Synthetic Peptide
PPVTGPRSALAPN

SEQ ID NO: 3825 - protein, 13 aa, Artificial Sequence
  Synthetic Peptide
GLPIIQRGLPRGG

SEQ ID NO: 3826 - protein, 13 aa, Artificial Sequence
  Synthetic Peptide
IQRGLPRGGLRGG

SEQ ID NO: 3827 - protein, 13 aa, Artificial Sequence
  Synthetic Peptide
LPRGGLRGGRATR

SEQ ID NO: 3828 - protein, 13 aa, Artificial Sequence
  Synthetic Peptide
GGLRGGRATRTLL

SEQ ID NO: 3829 - protein, 13 aa, Artificial Sequence
  Synthetic Peptide
ATRTLLRGGMSLR

SEQ ID NO: 3830 - protein, 13 aa, Artificial Sequence
  Synthetic Peptide
RGGMSLRGQNLLR

SEQ ID NO: 3831 - protein, 13 aa, Artificial Sequence
  Synthetic Peptide
RGQNLLRGGRAVA

SEQ ID NO: 3832 - protein, 13 aa, Artificial Sequence
  Synthetic Peptide
GRAVAPRMGLRRG

SEQ ID NO: 3833 - protein, 13 aa, Artificial Sequence
  Synthetic Peptide
PRMGLRRGGVRGR

SEQ ID NO: 3834 - protein, 13 aa, Artificial Sequence
  Synthetic Peptide
LRRGGVRGRGGPG

SEQ ID NO: 3835 - protein, 13 aa, Artificial Sequence
  Synthetic Peptide
RGGVRGRGGPGRG

SEQ ID NO: 3836 - protein, 13 aa, Artificial Sequence
  Synthetic Peptide
GRGGPGRGGLGRG

SEQ ID NO: 3837 - protein, 13 aa, Artificial Sequence
  Synthetic Peptide
RGRGRGRGALARP

SEQ ID NO: 3838 - protein, 13 aa, Artificial Sequence
  Synthetic Peptide
MDPATFRRKRPES

SEQ ID NO: 3839 - protein, 13 aa, Artificial Sequence
  Synthetic Peptide
APTTSIRFTLPPG

SEQ ID NO: 3840 - protein, 13 aa, Artificial Sequence
  Synthetic Peptide
APSMSVRGGGAGQ

SEQ ID NO: 3841 - protein, 13 aa, Artificial Sequence
  Synthetic Peptide
TQDRQIRFSQGQQ

SEQ ID NO: 3842 - protein, 13 aa, Artificial Sequence
  Synthetic Peptide
SDSERIRQYLPRN

SEQ ID NO: 3843 - protein, 13 aa, Artificial Sequence
  Synthetic Peptide
GAAGRGRGAGMPY

SEQ ID NO: 3844 - protein, 13 aa, Artificial Sequence
  Synthetic Peptide
DRRRYRRGYYGRR

SEQ ID NO: 3845 - protein, 13 aa, Artificial Sequence
  Synthetic Peptide
RQFSGARNQLRRP

SEQ ID NO: 3846 - protein, 13 aa, Artificial Sequence
  Synthetic Peptide
ARNQLRRPQYRPQ

SEQ ID NO: 3847 - protein, 13 aa, Artificial Sequence
  Synthetic Peptide
LRRPQYRPQYRQR

SEQ ID NO: 3848 - protein, 13 aa, Artificial Sequence
  Synthetic Peptide
PQYRQRRFPPYHV

SEQ ID NO: 3849 - protein, 13 aa, Artificial Sequence
  Synthetic Peptide
TFDRRSRVLPHPN

SEQ ID NO: 3850 - protein, 13 aa, Artificial Sequence
  Synthetic Peptide
NQPSVRRGYRRPY

SEQ ID NO: 3851 - protein, 13 aa, Artificial Sequence
  Synthetic Peptide
RPYNYRRRPRPPN

SEQ ID NO: 3852 - protein, 13 aa, Artificial Sequence
  Synthetic Peptide
EVAQSNRGRGRSR

SEQ ID NO: 3853 - protein, 13 aa, Artificial Sequence
  Synthetic Peptide
AQSNRGRGRSRPR

SEQ ID NO: 3854 - protein, 13 aa, Artificial Sequence
  Synthetic Peptide
SNRGRGRSRPRGG

SEQ ID NO: 3855 - protein, 13 aa, Artificial Sequence
  Synthetic Peptide
ANQSPFRAPLNVT

SEQ ID NO: 3856 - protein, 13 aa, Artificial Sequence
  Synthetic Peptide
YPFGTMRGGGFGD

SEQ ID NO: 3857 - protein, 13 aa, Artificial Sequence
  Synthetic Peptide
RDRDRDRGGFGAR

SEQ ID NO: 3858 - protein, 13 aa, Artificial Sequence
  Synthetic Peptide
RGGFGARGGGGLP

SEQ ID NO: 3859 - protein, 13 aa, Artificial Sequence
  Synthetic Peptide
MQLVDHRGGGGGG

SEQ ID NO: 3860 - protein, 13 aa, Artificial Sequence
  Synthetic Peptide
QFSGIGRSGQQPQ

SEQ ID NO: 3861 - protein, 13 aa, Artificial Sequence
  Synthetic Peptide
PRFGGSRAGPLSG

SEQ ID NO: 3862 - protein, 13 aa, Artificial Sequence
  Synthetic Peptide
LQLVEDRGSGRSR

SEQ ID NO: 3863 - protein, 13 aa, Artificial Sequence
  Synthetic Peptide
QQGAFGRGARSKK

SEQ ID NO: 3864 - protein, 13 aa, Artificial Sequence
  Synthetic Peptide
DNGSGYRRGGSSY

SEQ ID NO: 3865 - protein, 13 aa, Artificial Sequence
  Synthetic Peptide
NGSGYRRGGSSYS

SEQ ID NO: 3866 - protein, 13 aa, Artificial Sequence
  Synthetic Peptide
GVGGGYRGVSRGG

SEQ ID NO: 3867 - protein, 13 aa, Artificial Sequence
  Synthetic Peptide
GYRGVSRGGFRGN

SEQ ID NO: 3868 - protein, 13 aa, Artificial Sequence
  Synthetic Peptide
VSRGGFRGNSGGD

SEQ ID NO: 3869 - protein, 13 aa, Artificial Sequence
  Synthetic Peptide
GPSGGYRGSGGFQ

SEQ ID NO: 3870 - protein, 13 aa, Artificial Sequence
  Synthetic Peptide
  misc_feature (13)..(13): Xaa can be any naturally occurring amino acid
GYFGQGRGGGGYX

SEQ ID NO: 3871 - protein, 13 aa, Artificial Sequence
  Synthetic Peptide
PPYGDSRGPSPSY

SEQ ID NO: 3872 - protein, 13 aa, Artificial Sequence
  Synthetic Peptide
SYLGGPRGVAPSQ

SEQ ID NO: 3873 - protein, 13 aa, Artificial Sequence
  Synthetic Peptide
PSQFEERKDPHGE

SEQ ID NO: 3874 - protein, 13 aa, Artificial Sequence
  Synthetic Peptide
APFLGSRGGAPFQ

SEQ ID NO: 3875 - protein, 13 aa, Artificial Sequence
  Synthetic Peptide
FQFGGQRRPLLSQ

SEQ ID NO: 3876 - protein, 13 aa, Artificial Sequence
  Synthetic Peptide
QFGGQRRPLLSQL

SEQ ID NO: 3877 - protein, 13 aa, Artificial Sequence
  Synthetic Peptide
RVHSPPRFTNQRA

SEQ ID NO: 3878 - protein, 13 aa, Artificial Sequence
  Synthetic Peptide
LQFGGLRGSAPFS

SEQ ID NO: 3879 - protein, 13 aa, Artificial Sequence
  Synthetic Peptide
NEQTPSRFHFQGQ

SEQ ID NO: 3880 - protein, 13 aa, Artificial Sequence
  Synthetic Peptide
VMKPGPRPLLELP

SEQ ID NO: 3881 - protein, 13 aa, Artificial Sequence
  Synthetic Peptide
TGPVSGRYRHSMT

SEQ ID NO: 3882 - protein, 13 aa, Artificial Sequence
  Synthetic Peptide
PVSGRYRHSMTNL

SEQ ID NO: 3883 - protein, 13 aa, Artificial Sequence
  Synthetic Peptide
PQHPPHRTASVFG

SEQ ID NO: 3884 - protein, 13 aa, Artificial Sequence
  Synthetic Peptide
PSLSGARSAPRLN

SEQ ID NO: 3885 - protein, 13 aa, Artificial Sequence
  Synthetic Peptide
QPPALGRGGSGGG

SEQ ID NO: 3886 - protein, 13 aa, Artificial Sequence
  Synthetic Peptide
APAAAARGAPVAA

SEQ ID NO: 3887 - protein, 13 aa, Artificial Sequence
  Synthetic Peptide
RGGLPPREGRGMP

SEQ ID NO: 3888 - protein, 13 aa, Artificial Sequence
  Synthetic Peptide
PGGPMGRMGGRGG

SEQ ID NO: 3889 - protein, 13 aa, Artificial Sequence
  Synthetic Peptide
HAGRWGRQGSSYH

SEQ ID NO: 3890 - protein, 13 aa, Artificial Sequence
  Synthetic Peptide
TGSGYSRSSQGQP

SEQ ID NO: 3891 - protein, 13 aa, Artificial Sequence
  Synthetic Peptide
GPSSYPRPLTYPQ

SEQ ID NO: 3892 - protein, 13 aa, Artificial Sequence
  Synthetic Peptide
EPHFYLRCLGKNG

SEQ ID NO: 3893 - protein, 13 aa, Artificial Sequence
  Synthetic Peptide
DGAFQRRGAPALQ

SEQ ID NO: 3894 - protein, 13 aa, Artificial Sequence
  Synthetic Peptide
PKQCTFRFPSTAI

SEQ ID NO: 3895 - protein, 13 aa, Artificial Sequence
  Synthetic Peptide
PRVCTFRFPSTNI

SEQ ID NO: 3896 - protein, 13 aa, Artificial Sequence
  Synthetic Peptide
GPGPGGRGRGRGQ

SEQ ID NO: 3897 - protein, 13 aa, Artificial Sequence
  Synthetic Peptide
VGLVIGRGGETIK

SEQ ID NO: 3898 - protein, 13 aa, Artificial Sequence
  Synthetic Peptide
GGLAAARGRGRGR

SEQ ID NO: 3899 - protein, 13 aa, Artificial Sequence
  Synthetic Peptide
LAAARGRGRGRGD

SEQ ID NO: 3900 - protein, 13 aa, Artificial Sequence
  Synthetic Peptide
SGGYEPRGRGGGR

SEQ ID NO: 3901 - protein, 13 aa, Artificial Sequence
  Synthetic Peptide
RGRGGGRGGRGGM

SEQ ID NO: 3902 - protein, 13 aa, Artificial Sequence
  Synthetic Peptide
GGGRGGRGGMGGS

SEQ ID NO: 3903 - protein, 13 aa, Artificial Sequence
  Synthetic Peptide
GMGGSDRGGFNKF

SEQ ID NO: 3904 - protein, 13 aa, Artificial Sequence
  Synthetic Peptide
KVSFATRRADFNR

SEQ ID NO: 3905 - protein, 13 aa, Artificial Sequence
  Synthetic Peptide
GRGGGDRGGFGPG

SEQ ID NO: 3906 - protein, 13 aa, Artificial Sequence
  Synthetic Peptide
PGKMDSRGEHRQD

SEQ ID NO: 3907 - protein, 13 aa, Artificial Sequence
  Synthetic Peptide
TGGQMCRPHLLHS

SEQ ID NO: 3908 - protein, 13 aa, Artificial Sequence
  Synthetic Peptide
LQTSSARMPGSVI

SEQ ID NO: 3909 - protein, 13 aa, Artificial Sequence
  Synthetic Peptide
IPPPLVRGGQQAS

SEQ ID NO: 3910 - protein, 13 aa, Artificial Sequence
  Synthetic Peptide
VMPPLVRGAQQIH

SEQ ID NO: 3911 - protein, 13 aa, Artificial Sequence
  Synthetic Peptide
QQIHSIRQHSSTG

SEQ ID NO: 3912 - protein, 13 aa, Artificial Sequence
  Synthetic Peptide
VQIQGQRIIQQGL

SEQ ID NO: 3913 - protein, 13 aa, Artificial Sequence
  Synthetic Peptide
IQQGLIRVANVPN

SEQ ID NO: 3914 - protein, 13 aa, Artificial Sequence
  Synthetic Peptide
ASSQLSRGSATTP

SEQ ID NO: 3915 - protein, 13 aa, Artificial Sequence
  Synthetic Peptide
GSATTPRGVLHTF

SEQ ID NO: 3916 - protein, 13 aa, Artificial Sequence
  Synthetic Peptide
MTEDALRLNLLKR

SEQ ID NO: 3917 - protein, 13 aa, Artificial Sequence
  Synthetic Peptide
AQLQGQRGPPKPG

SEQ ID NO: 3918 - protein, 13 aa, Artificial Sequence
  Synthetic Peptide
QPGTVNRVSSPLP

SEQ ID NO: 3919 - protein, 13 aa, Artificial Sequence
  Synthetic Peptide
MRHHTLRQAPQPQ

SEQ ID NO: 3920 - protein, 13 aa, Artificial Sequence
  Synthetic Peptide
TENINHRGGYHGG

SEQ ID NO: 3921 - protein, 13 aa, Artificial Sequence
  Synthetic Peptide
GWHSSSRGHDGMS

SEQ ID NO: 3922 - protein, 13 aa, Artificial Sequence
  Synthetic Peptide
QLLQVVRAANGAQ

SEQ ID NO: 3923 - protein, 13 aa, Artificial Sequence
  Synthetic Peptide
AAGAGPRGGRSPA

SEQ ID NO: 3924 - protein, 13 aa, Artificial Sequence
  Synthetic Peptide
AGASGHRAGAGGR

SEQ ID NO: 3925 - protein, 13 aa, Artificial Sequence
  Synthetic Peptide
VSNPATRMLKTAA

SEQ ID NO: 3926 - protein, 13 aa, Artificial Sequence
  Synthetic Peptide
QPGTILRTVPMGG

SEQ ID NO: 3927 - protein, 13 aa, Artificial Sequence
  Synthetic Peptide
MKPHRIRMTHNLL

SEQ ID NO: 3928 - protein, 13 aa, Artificial Sequence
  Synthetic Peptide
NRGGGHRGRGGFN

SEQ ID NO: 3929 - protein, 13 aa, Artificial Sequence
  Synthetic Peptide
GGGHRGRGGFNMR

SEQ ID NO: 3930 - protein, 13 aa, Artificial Sequence
  Synthetic Peptide
RGGFNMRGGNFRG

SEQ ID NO: 3931 - protein, 13 aa, Artificial Sequence
  Synthetic Peptide
MRGGNFRGGAPGN

SEQ ID NO: 3932 - protein, 13 aa, Artificial Sequence
  Synthetic Peptide
GKNQFNRGGGHRG

SEQ ID NO: 3933 - protein, 13 aa, Artificial Sequence
  Synthetic Peptide
GGAPGNRGGYNRR

SEQ ID NO: 3934 - protein, 13 aa, Artificial Sequence
  Synthetic Peptide
IGYPYPRAPVFPG

SEQ ID NO: 3935 - protein, 13 aa, Artificial Sequence
  Synthetic Peptide
APVFPGRGSYSNR

SEQ ID NO: 3936 - protein, 13 aa, Artificial Sequence
  Synthetic Peptide
RGSYSNRGNYNRG

SEQ ID NO: 3937 - protein, 13 aa, Artificial Sequence
  Synthetic Peptide
NRGNYNRGGMPNR

SEQ ID NO: 3938 - protein, 13 aa, Artificial Sequence
  Synthetic Peptide
RGGMPNRGNYNQN

SEQ ID NO: 3939 - protein, 13 aa, Artificial Sequence
  Synthetic Peptide
NYNQNFRGRGNNR

SEQ ID NO: 3940 - protein, 13 aa, Artificial Sequence
  Synthetic Peptide
VSGLGSRGLTLAP

SEQ ID NO: 3941 - protein, 13 aa, Artificial Sequence
  Synthetic Peptide
NAEASLRRNSPSP

SEQ ID NO: 3942 - protein, 13 aa, Artificial Sequence
  Synthetic Peptide
AYSYCGRGFYPQY

SEQ ID NO: 3943 - protein, 13 aa, Artificial Sequence
  Synthetic Peptide
YGALETRGGFNPR

SEQ ID NO: 3944 - protein, 13 aa, Artificial Sequence
  Synthetic Peptide
RGGFNPRVERTLL

SEQ ID NO: 3945 - protein, 13 aa, Artificial Sequence
  Synthetic Peptide
GHPTAGRGRSELC

SEQ ID NO: 3946 - protein, 13 aa, Artificial Sequence
  Synthetic Peptide
VGVVVPRGTPTPR

SEQ ID NO: 3947 - protein, 13 aa, Artificial Sequence
  Synthetic Peptide
RGLLTPRARGVPP

SEQ ID NO: 3948 - protein, 13 aa, Artificial Sequence
  Synthetic Peptide
  misc_feature (1)..(5): Xaa can be any naturally occurring amino acid
XXXXXMRAHPGGG

SEQ ID NO: 3949 - protein, 13 aa, Artificial Sequence
  Synthetic Peptide
PRVDPYRPVRLPM

SEQ ID NO: 3950 - protein, 13 aa, Artificial Sequence
  Synthetic Peptide
DPYRPVRLPMQKL

SEQ ID NO: 3951 - protein, 13 aa, Artificial Sequence
  Synthetic Peptide
TRHLQQRPSGYVH

SEQ ID NO: 3952 - protein, 13 aa, Artificial Sequence
  Synthetic Peptide
GLTSTQRFSHQTL

SEQ ID NO: 3953 - protein, 13 aa, Artificial Sequence
  Synthetic Peptide
AVLANIRSPVFNH

SEQ ID NO: 3954 - protein, 13 aa, Artificial Sequence
  Synthetic Peptide
KSEAGARGGGQGS

SEQ ID NO: 3955 - protein, 13 aa, Artificial Sequence
  Synthetic Peptide
EGQGQGRGLGLVS

SEQ ID NO: 3956 - protein, 13 aa, Artificial Sequence
  Synthetic Peptide
VKRAGPRLLLIPV

SEQ ID NO: 3957 - protein, 13 aa, Artificial Sequence
  Synthetic Peptide
QGSPTLRPVSNTQ

SEQ ID NO: 3958 - protein, 13 aa, Artificial Sequence
  Synthetic Peptide
TQLQGHRMVLQPV

SEQ ID NO: 3959 - protein, 13 aa, Artificial Sequence
  Synthetic Peptide
RAAKSSRGNGHFQ

SEQ ID NO: 3960 - protein, 13 aa, Artificial Sequence
  Synthetic Peptide
LQLQQQRMQLAQK

SEQ ID NO: 3961 - protein, 13 aa, Artificial Sequence
  Synthetic Peptide
ALPRLSRSPFTST

SEQ ID NO: 3962 - protein, 13 aa, Artificial Sequence
  Synthetic Peptide
MQRSKMRGASSGK

SEQ ID NO: 3963 - protein, 13 aa, Artificial Sequence
  Synthetic Peptide
LELQGPRGSPNAR

SEQ ID NO: 3964 - protein, 13 aa, Artificial Sequence
  Synthetic Peptide
RGSPNARSQPSKT

SEQ ID NO: 3965 - protein, 13 aa, Artificial Sequence
  Synthetic Peptide
ARIVTDRETGSSK

SEQ ID NO: 3966 - protein, 13 aa, Artificial Sequence
  Synthetic Peptide
QLIQQQRAMLMRQ

SEQ ID NO: 3967 - protein, 13 aa, Artificial Sequence
  Synthetic Peptide
RLQLQHRLQAQQN

SEQ ID NO: 3968 - protein, 13 aa, Artificial Sequence
  Synthetic Peptide
QQQVQQRTLMMRG

SEQ ID NO: 3969 - protein, 13 aa, Artificial Sequence
  Synthetic Peptide
QRTLMMRGQGLNM

SEQ ID NO: 3970 - protein, 13 aa, Artificial Sequence
  Synthetic Peptide
YNTSLPRPALGGS

SEQ ID NO: 3971 - protein, 13 aa, Artificial Sequence
  Synthetic Peptide
NRSQDVRMNGPMG

SEQ ID NO: 3972 - protein, 13 aa, Artificial Sequence
  Synthetic Peptide
GSPVTTREPTPRL

SEQ ID NO: 3973 - protein, 13 aa, Artificial Sequence
  Synthetic Peptide
AAYYLPRHLAPNP

SEQ ID NO: 3974 - protein, 13 aa, Artificial Sequence
  Synthetic Peptide
QRADMLRGLSPRE

SEQ ID NO: 3975 - protein, 13 aa, Artificial Sequence
  Synthetic Peptide
NYAAGPRGIIDLS

SEQ ID NO: 3976 - protein, 13 aa, Artificial Sequence
  Synthetic Peptide
AVAAVGRYPKPLA

SEQ ID NO: 3977 - protein, 13 aa, Artificial Sequence
  Synthetic Peptide
KKRGSYRGGSISV

SEQ ID NO: 3978 - protein, 13 aa, Artificial Sequence
  Synthetic Peptide
TPPAFNRAAPGAE

SEQ ID NO: 3979 - protein, 13 aa, Artificial Sequence
  Synthetic Peptide
PAPYGERMSPNQL

SEQ ID NO: 3980 - protein, 13 aa, Artificial Sequence
  Synthetic Peptide
VLSPLQRAQLLGG

SEQ ID NO: 3981 - protein, 13 aa, Artificial Sequence
  Synthetic Peptide
PPAPGFRAFFSAP

SEQ ID NO: 3982 - protein, 13 aa, Artificial Sequence
  Synthetic Peptide
SPRLGRRGSRLSG

SEQ ID NO: 3983 - protein, 13 aa, Artificial Sequence
  Synthetic Peptide
LGRRGSRLSGALP

SEQ ID NO: 3984 - protein, 13 aa, Artificial Sequence
  Synthetic Peptide
RPQSRPRLPATGT

SEQ ID NO: 3985 - protein, 13 aa, Artificial Sequence
  Synthetic Peptide
LPGQPQRMMGPLS

SEQ ID NO: 3986 - protein, 13 aa, Artificial Sequence
  Synthetic Peptide
PLSQASRYIGPQN

SEQ ID NO: 3987 - protein, 13 aa, Artificial Sequence
  Synthetic Peptide
DQQQLDRPFNRGK

SEQ ID NO: 3988 - protein, 13 aa, Artificial Sequence
  Synthetic Peptide
LDRPFNRGKGDRQ

SEQ ID NO: 3989 - protein, 13 aa, Artificial Sequence
  Synthetic Peptide
IRMWQTREKAKFS

SEQ ID NO: 3990 - protein, 13 aa, Artificial Sequence
  Synthetic Peptide
QWMTAGRGILHAE

SEQ ID NO: 3991 - protein, 13 aa, Artificial Sequence
  Synthetic Peptide
LLYRAQRAIRLRH

SEQ ID NO: 3992 - protein, 13 aa, Artificial Sequence
  Synthetic Peptide
RAQRAIRLRHALR

SEQ ID NO: 3993 - protein, 13 aa, Artificial Sequence
  Synthetic Peptide
QRAIRLRHALRLH

SEQ ID NO: 3994 - protein, 13 aa, Artificial Sequence
  Synthetic Peptide
GSLLLRRGFSDSG

SEQ ID NO: 3995 - protein, 13 aa, Artificial Sequence
  Synthetic Peptide
KIHSRARGPIQIL

SEQ ID NO: 3996 - protein, 13 aa, Artificial Sequence
  Synthetic Peptide
PEPFGSRGSPRKA

SEQ ID NO: 3997 - protein, 13 aa, Artificial Sequence
  Synthetic Peptide
PLSPKGRPSSPRT

SEQ ID NO: 3998 - protein, 13 aa, Artificial Sequence
  Synthetic Peptide
GRPSSPRTPLYLQ

SEQ ID NO: 3999 - protein, 13 aa, Artificial Sequence
  Synthetic Peptide
AGSSLGRAPSPRP

SEQ ID NO: 4000 - protein, 13 aa, Artificial Sequence
  Synthetic Peptide
GRAPSPRPGPGPL

SEQ ID NO: 4001 - protein, 13 aa, Artificial Sequence
  Synthetic Peptide
PGPGPLRQQGPPT

SEQ ID NO: 4002 - protein, 13 aa, Artificial Sequence
  Synthetic Peptide
PFDFLGRAGSPRG

SEQ ID NO: 4003 - protein, 13 aa, Artificial Sequence
  Synthetic Peptide
GRAGSPRGSPLAE

SEQ ID NO: 4004 - protein, 13 aa, Artificial Sequence
  Synthetic Peptide
QAFFPERGPSPRP

SEQ ID NO: 4005 - protein, 13 aa, Artificial Sequence
  Synthetic Peptide
ERGPSPRPPATAY

SEQ ID NO: 4006 - protein, 13 aa, Artificial Sequence
  Synthetic Peptide
GSPLFTRAPPPKL

SEQ ID NO: 4007 - protein, 13 aa, Artificial Sequence
  Synthetic Peptide
PVALQTRLAKRGI

SEQ ID NO: 4008 - protein, 13 aa, Artificial Sequence
  Synthetic Peptide
EKILILRQTTADW

SEQ ID NO: 4009 - protein, 13 aa, Artificial Sequence
  Synthetic Peptide
DWWWGERAGCCGY

SEQ ID NO: 4010 - protein, 13 aa, Artificial Sequence
  Synthetic Peptide
TTAAAFRGAHLRG

SEQ ID NO: 4011 - protein, 13 aa, Artificial Sequence
  Synthetic Peptide
GGYAAYRYAQPAT

SEQ ID NO: 4012 - protein, 13 aa, Artificial Sequence
  Synthetic Peptide
AVASLYRGGYSRF

SEQ ID NO: 4013 - protein, 13 aa, Artificial Sequence
  Synthetic Peptide
  misc_feature (9)..(13): Xaa can be any naturally occurring amino acid
HSGYQRRMXXXXX

SEQ ID NO: 4014 - protein, 13 aa, Artificial Sequence
  Synthetic Peptide
GRFLQPRLAPNQP

SEQ ID NO: 4015 - protein, 13 aa, Artificial Sequence
  Synthetic Peptide
PPPPLIRPALAAP

SEQ ID NO: 4016 - protein, 13 aa, Artificial Sequence
  Synthetic Peptide
PALAAPRHSARPG

SEQ ID NO: 4017 - protein, 13 aa, Artificial Sequence
  Synthetic Peptide
APRHSARPGPQPP

SEQ ID NO: 4018 - protein, 13 aa, Artificial Sequence
  Synthetic Peptide
ARFIQPRPTLNQP

SEQ ID NO: 4019 - protein, 13 aa, Artificial Sequence
  Synthetic Peptide
PPPPLIRPANSMP

SEQ ID NO: 4020 - protein, 13 aa, Artificial Sequence
  Synthetic Peptide
PSVPTGRAMPSRR

SEQ ID NO: 4021 - protein, 13 aa, Artificial Sequence
  Synthetic Peptide
LLPRAPRSLIPPI

SEQ ID NO: 4022 - protein, 13 aa, Artificial Sequence
  Synthetic Peptide
TLPLSSRAGAPPA

SEQ ID NO: 4023 - protein, 13 aa, Artificial Sequence
  Synthetic Peptide
VTYESERGGFRRT

SEQ ID NO: 4024 - protein, 13 aa, Artificial Sequence
  Synthetic Peptide
SYPRLPRGQGAYR

SEQ ID NO: 4025 - protein, 13 aa, Artificial Sequence
  Synthetic Peptide
DFDHRDRGRYPDH

SEQ ID NO: 4026 - protein, 13 aa, Artificial Sequence
  Synthetic Peptide
KRMSEGRGLPPPP

SEQ ID NO: 4027 - protein, 13 aa, Artificial Sequence
  Synthetic Peptide
PGHMMNRGGMSGR

SEQ ID NO: 4028 - protein, 13 aa, Artificial Sequence
  Synthetic Peptide
RGGMSGRGSFAPG

SEQ ID NO: 4029 - protein, 13 aa, Artificial Sequence
  Synthetic Peptide
APGGASRGHPIPH

SEQ ID NO: 4030 - protein, 13 aa, Artificial Sequence
  Synthetic Peptide
GFGGQSRGSRPSD

SEQ ID NO: 4031 - protein, 13 aa, Artificial Sequence
  Synthetic Peptide
KRLSEGRGLPPPP

SEQ ID NO: 4032 - protein, 13 aa, Artificial Sequence
  Synthetic Peptide
PGHMASRGGVAGR

SEQ ID NO: 4033 - protein, 13 aa, Artificial Sequence
  Synthetic Peptide
RGGVAGRGGFAQG

SEQ ID NO: 4034 - protein, 13 aa, Artificial Sequence
  Synthetic Peptide
GASHLPRGAAAAA

SEQ ID NO: 4035 - protein, 13 aa, Artificial Sequence
  Synthetic Peptide
QLSLLPRALQRPS

SEQ ID NO: 4036 - protein, 13 aa, Artificial Sequence
  Synthetic Peptide
HPKPPHRGGGEPR

SEQ ID NO: 4037 - protein, 13 aa, Artificial Sequence
  Synthetic Peptide
RGGGEPRGGRQHH

SEQ ID NO: 4038 - protein, 13 aa, Artificial Sequence
  Synthetic Peptide
GEPRGGRQHHPPY

SEQ ID NO: 4039 - protein, 13 aa, Artificial Sequence
  Synthetic Peptide
TPAGYGRGREEYE

SEQ ID NO: 4040 - protein, 13 aa, Artificial Sequence
  Synthetic Peptide
AGYGRGREEYEGP

SEQ ID NO: 4041 - protein, 13 aa, Artificial Sequence
  Synthetic Peptide
  misc_feature (9)..(13): Xaa can be any naturally occurring amino acid
GPNKKPRFXXXXX

SEQ ID NO: 4042 - protein, 13 aa, Artificial Sequence
  Synthetic Peptide
AERARGRPLGAVD

SEQ ID NO: 4043 - protein, 13 aa, Artificial Sequence
  Synthetic Peptide
SGNSMPRGSGSGF

SEQ ID NO: 4044 - protein, 13 aa, Artificial Sequence
  Synthetic Peptide
PAAQYQRPGMSPG

SEQ ID NO: 4045 - protein, 13 aa, Artificial Sequence
  Synthetic Peptide
GMSPGNRMPMAGL

SEQ ID NO: 4046 - protein, 13 aa, Artificial Sequence
  Synthetic Peptide
GAAAPLRPGMPPT

SEQ ID NO: 4047 - protein, 13 aa, Artificial Sequence
  Synthetic Peptide
  misc_feature (10)..(13): Xaa can be any naturally occurring amino acid
EQVLGIRLTXXXX

SEQ ID NO: 4048 - protein, 13 aa, Artificial Sequence
  Synthetic Peptide
  misc_feature (1)..(3): Xaa can be any naturally occurring amino acid
XXXMSKRPSYAPP

SEQ ID NO: 4049 - protein, 13 aa, Artificial Sequence
  Synthetic Peptide
LAYNNYRLGGNPG

SEQ ID NO: 4050 - protein, 13 aa, Artificial Sequence
  Synthetic Peptide
  misc_feature (1)..(3): Xaa can be any naturally occurring amino acid
XXXMHRRGVGAGA

SEQ ID NO: 4051 - protein, 13 aa, Artificial Sequence
  Synthetic Peptide
VYDQAWRGGKDMA

SEQ ID NO: 4052 - protein, 13 aa, Artificial Sequence
  Synthetic Peptide
REVSGFRGGGGGP

SEQ ID NO: 4053 - protein, 13 aa, Artificial Sequence
  Synthetic Peptide
SITYSIRPEALHS

SEQ ID NO: 4054 - protein, 13 aa, Artificial Sequence
  Synthetic Peptide
EALHSPRAPLQPQ

SEQ ID NO: 4055 - protein, 13 aa, Artificial Sequence
  Synthetic Peptide
PQQIEVRAPQRAS

SEQ ID NO: 4056 - protein, 13 aa, Artificial Sequence
  Synthetic Peptide
QAGGPRRSLLTKR

SEQ ID NO: 4057 - protein, 13 aa, Artificial Sequence
  Synthetic Peptide
RGANGGRVPGNGA

SEQ ID NO: 4058 - protein, 13 aa, Artificial Sequence
  Synthetic Peptide
KKSTPSRGSSSKS

SEQ ID NO: 4059 - protein, 13 aa, Artificial Sequence
  Synthetic Peptide
SRGSTVRSKKSKP

SEQ ID NO: 4060 - protein, 13 aa, Artificial Sequence
  Synthetic Peptide
SVHSSGRGSNRGS

SEQ ID NO: 4061 - protein, 13 aa, Artificial Sequence
  Synthetic Peptide
SGRGSNRGSRHSS

SEQ ID NO: 4062 - protein, 13 aa, Artificial Sequence
  Synthetic Peptide
GSNRGSRHSSAPP

SEQ ID NO: 4063 - protein, 13 aa, Artificial Sequence
  Synthetic Peptide
AWKTRGRGAANDS

SEQ ID NO: 4064 - protein, 13 aa, Artificial Sequence
  Synthetic Peptide
ATTSGIRATLTPT

SEQ ID NO: 4065 - protein, 13 aa, Artificial Sequence
  Synthetic Peptide
KPGALIRPPQVTL

SEQ ID NO: 4066 - protein, 13 aa, Artificial Sequence
  Synthetic Peptide
TPMVALRQPHNRI

SEQ ID NO: 4067 - protein, 13 aa, Artificial Sequence
  Synthetic Peptide
KSRFAPRGAPHFR

SEQ ID NO: 4068 - protein, 13 aa, Artificial Sequence
  Synthetic Peptide
RGAPHFRFIIAGR

SEQ ID NO: 4069 - protein, 13 aa, Artificial Sequence
  Synthetic Peptide
RFIIAGRQAGRRC

SEQ ID NO: 4070 - protein, 13 aa, Artificial Sequence
  Synthetic Peptide
GPSPASRYVQKLP

SEQ ID NO: 4071 - protein, 13 aa, Artificial Sequence
  Synthetic Peptide
LTAPNYRLKSLQK

SEQ ID NO: 4072 - protein, 13 aa, Artificial Sequence
  Synthetic Peptide
MSLTGQRFTVQMP

SEQ ID NO: 4073 - protein, 13 aa, Artificial Sequence
  Synthetic Peptide
FNPGELRMAQQQA

SEQ ID NO: 4074 - protein, 13 aa, Artificial Sequence
  Synthetic Peptide
AQQQALRFRGPAP

SEQ ID NO: 4075 - protein, 13 aa, Artificial Sequence
  Synthetic Peptide
GPPPLMRPPPPFG

SEQ ID NO: 4076 - protein, 13 aa, Artificial Sequence
  Synthetic Peptide
GSGGGRRGAAAAA

SEQ ID NO: 4077 - protein, 13 aa, Artificial Sequence
  Synthetic Peptide
MSPGRSRGPGGDP

SEQ ID NO: 4078 - protein, 13 aa, Artificial Sequence
  Synthetic Peptide
KRYFGARAILGEQ

SEQ ID NO: 4079 - protein, 13 aa, Artificial Sequence
  Synthetic Peptide
AILGEQRPRQRQR

SEQ ID NO: 4080 - protein, 13 aa, Artificial Sequence
  Synthetic Peptide
AAGGGGRNRPAPY

SEQ ID NO: 4081 - protein, 13 aa, Artificial Sequence
  Synthetic Peptide
GGGGRNRPAPYSR

SEQ ID NO: 4082 - protein, 13 aa, Artificial Sequence
  Synthetic Peptide
PRVYQNRDFRGHN

SEQ ID NO: 4083 - protein, 13 aa, Artificial Sequence
  Synthetic Peptide
YQNRDFRGHNRGY

SEQ ID NO: 4084 - protein, 13 aa, Artificial Sequence
  Synthetic Peptide
GAFPRGRGRFMFR

SEQ ID NO: 4085 - protein, 13 aa, Artificial Sequence
  Synthetic Peptide
FPRGRGRFMFRKS

SEQ ID NO: 4086 - protein, 13 aa, Artificial Sequence
  Synthetic Peptide
MAEKKTRALQRGN

SEQ ID NO: 4087 - protein, 13 aa, Artificial Sequence
  Synthetic Peptide
KTRALQRGNRHSR

SEQ ID NO: 4088 - protein, 13 aa, Artificial Sequence
  Synthetic Peptide
AYQAAIRGVGSAQ

SEQ ID NO: 4089 - protein, 13 aa, Artificial Sequence
  Synthetic Peptide
FGPLGPRMSQLFH

SEQ ID NO: 4090 - protein, 13 aa, Artificial Sequence
  Synthetic Peptide
LKRHESRGNQSGR

SEQ ID NO: 4091 - protein, 13 aa, Artificial Sequence
  Synthetic Peptide
PNNPFSRVALEFG

SEQ ID NO: 4092 - protein, 13 aa, Artificial Sequence
  Synthetic Peptide
EEAARGRGGGAEE

SEQ ID NO: 4093 - protein, 13 aa, Artificial Sequence
  Synthetic Peptide
EATEAGRGGRRRS

SEQ ID NO: 4094 - protein, 13 aa, Artificial Sequence
  Synthetic Peptide
EAGRGGRRRSPRQ

SEQ ID NO: 4095 - protein, 13 aa, Artificial Sequence
  Synthetic Peptide
SNGPGNRAGSSSS

SEQ ID NO: 4096 - protein, 13 aa, Artificial Sequence
  Synthetic Peptide
HYTSFIRQHKDQW

SEQ ID NO: 4097 - protein, 13 aa, Artificial Sequence
  Synthetic Peptide
SLSSFFRGRTRPG

SEQ ID NO: 4098 - protein, 13 aa, Artificial Sequence
  Synthetic Peptide
FPPYYMRRPYGRR

SEQ ID NO: 4099 - protein, 13 aa, Artificial Sequence
  Synthetic Peptide
PPYYMRRPYGRRP

SEQ ID NO: 4100 - protein, 13 aa, Artificial Sequence
  Synthetic Peptide
VRQNMYRGYRPRF

SEQ ID NO: 4101 - protein, 13 aa, Artificial Sequence
  Synthetic Peptide
SYLESPRGPRFDG

SEQ ID NO: 4102 - protein, 13 aa, Artificial Sequence
  Synthetic Peptide
ESPRGPRFDGPRR

SEQ ID NO: 4103 - protein, 13 aa, Artificial Sequence
  Synthetic Peptide
PRFDGPRRFEDLG

SEQ ID NO: 4104 - protein, 13 aa, Artificial Sequence
  Synthetic Peptide
PRPKGPRFEGNRP

SEQ ID NO: 4105 - protein, 13 aa, Artificial Sequence
  Synthetic Peptide
PRFEGNRPDGPRP

SEQ ID NO: 4106 - protein, 13 aa, Artificial Sequence
  Synthetic Peptide
NRPDGPRPRYEGH

SEQ ID NO: 4107 - protein, 13 aa, Artificial Sequence
  Synthetic Peptide
PDGPRPRYEGHPA

SEQ ID NO: 4108 - protein, 13 aa, Artificial Sequence
  Synthetic Peptide
PPPGSYRPPPPMG

SEQ ID NO: 4109 - protein, 13 aa, Artificial Sequence
  Synthetic Peptide
PPGSIVRPSAPPA

SEQ ID NO: 4110 - protein, 13 aa, Artificial Sequence
  Synthetic Peptide
PSAPPARSSVPVT

SEQ ID NO: 4111 - protein, 13 aa, Artificial Sequence
  Synthetic Peptide
HAVVLPRGKSLDQ

SEQ ID NO: 4112 - protein, 13 aa, Artificial Sequence
  Synthetic Peptide
PLYAGQRLPQHGY

SEQ ID NO: 4113 - protein, 13 aa, Artificial Sequence
  Synthetic Peptide
QAQPLPRQGVKRT

SEQ ID NO: 4114 - protein, 13 aa, Artificial Sequence
  Synthetic Peptide
HVAEGCRGGRGGG

SEQ ID NO: 4115 - protein, 13 aa, Artificial Sequence
  Synthetic Peptide
NTSSSRRKTKSKS

SEQ ID NO: 4116 - protein, 13 aa, Artificial Sequence
  Synthetic Peptide
PGPAGFRGSSRGE

SEQ ID NO: 4117 - protein, 13 aa, Artificial Sequence
  Synthetic Peptide
FMEDRGRENYSSY

SEQ ID NO: 4118 - protein, 13 aa, Artificial Sequence
  Synthetic Peptide
PAPVGSRGRGTPA

SEQ ID NO: 4119 - protein, 13 aa, Artificial Sequence
  Synthetic Peptide
ESTFGSRNYDAFG

SEQ ID NO: 4120 - protein, 13 aa, Artificial Sequence
  Synthetic Peptide
TKSSFRRGGHTWV

SEQ ID NO: 4121 - protein, 13 aa, Artificial Sequence
  Synthetic Peptide
YALYGQRLTTASA

SEQ ID NO: 4122 - protein, 13 aa, Artificial Sequence
  Synthetic Peptide
FGQGAARGFKSNK

SEQ ID NO: 4123 - protein, 13 aa, Artificial Sequence
  Synthetic Peptide
GPGLEHRGTLRTQ

SEQ ID NO: 4124 - protein, 13 aa, Artificial Sequence
  Synthetic Peptide
DCGKSYRSFSNLW

SEQ ID NO: 4125 - protein, 13 aa, Artificial Sequence
  Synthetic Peptide
RGRGRGRGRGGAG

SEQ ID NO: 4126 - protein, 13 aa, Artificial Sequence
  Synthetic Peptide
RGRGRGRGGAGAP

SEQ ID NO: 4127 - protein, 13 aa, Artificial Sequence
  Synthetic Peptide
AVGTGGRGTHDRD

SEQ ID NO: 4128 - protein, 13 aa, Artificial Sequence
  Synthetic Peptide
RRGGRARGGQGPR

SEQ ID NO: 4129 - protein, 13 aa, Artificial Sequence
  Synthetic Peptide
CGKSFGRGSTLIQ

SEQ ID NO: 4130 - protein, 13 aa, Artificial Sequence
  Synthetic Peptide
RYGEDVRSALLDP

SEQ ID NO: 4131 - protein, 13 aa, Artificial Sequence
  Synthetic Peptide
WVCPPCRGICNCS

SEQ ID NO: 4132 - protein, 13 aa, Artificial Sequence
  Synthetic Peptide
SLSPTARTYLQMK

SEQ ID NO: 4133 - protein, 13 aa, Artificial Sequence
  Synthetic Peptide
RYAADRRRYRRGY

SEQ ID NO: 4134 - protein, 13 aa, Artificial Sequence
  Synthetic Peptide
HRNPTYRPRYRSR

SEQ ID NO: 4135 - protein, 13 aa, Artificial Sequence
  Synthetic Peptide
NPTYRPRYRSRGP

SEQ ID NO: 4136 - protein, 13 aa, Artificial Sequence
  Synthetic Peptide
TYRPRYRSRGPPR

SEQ ID NO: 4137 - protein, 13 aa, Artificial Sequence
  Synthetic Peptide
PNQPSVRRGYRRP

SEQ ID NO: 4138 - protein, 13 aa, Artificial Sequence
  Synthetic Peptide
PYNYRRRPRPPNA

SEQ ID NO: 4139 - protein, 13 aa, Artificial Sequence
  Synthetic Peptide
NYRRRPRPPNAPS

SEQ ID NO: 4140 - protein, 13 aa, Artificial Sequence
  Synthetic Peptide
HPRGAGRGSLWRF

SEQ ID NO: 4141 - protein, 13 aa, Artificial Sequence
  Synthetic Peptide
ISLAQLRLQHMQQ

SEQ ID NO: 4142 - protein, 13 aa, Artificial Sequence
  Synthetic Peptide
LITFQLRHILKAR

SEQ ID NO: 4143 - protein, 13 aa, Artificial Sequence
  Synthetic Peptide
QQLQQMRMQQPPA

SEQ ID NO: 4144 - protein, 13 aa, Artificial Sequence
  Synthetic Peptide
FQAHQMRLAQNAA

SEQ ID NO: 4145 - protein, 13 aa, Artificial Sequence
  Synthetic Peptide
LPTCMYRLPNVHG

SEQ ID NO: 4146 - protein, 13 aa, Artificial Sequence
  Synthetic Peptide
ATKRKRRGGFAVQ

SEQ ID NO: 4147 - protein, 13 aa, Artificial Sequence
  Synthetic Peptide
MSWKYSRGAGLGF

SEQ ID NO: 4148 - protein, 13 aa, Artificial Sequence
  Synthetic Peptide
DPHHRVRFHNPRT

SEQ ID NO: 4149 - protein, 13 aa, Artificial Sequence
  Synthetic Peptide
LKAERERGITIDI

SEQ ID NO: 4150 - protein, 13 aa, Artificial Sequence
  Synthetic Peptide
RGLDEDRGSWRTA

SEQ ID NO: 4151 - protein, 13 aa, Artificial Sequence
  Synthetic Peptide
  misc_feature (12)..(13): Xaa can be any naturally occurring amino acid
QNLWKPRLNVPXX

SEQ ID NO: 4152 - protein, 13 aa, Artificial Sequence
  Synthetic Peptide
PSSAASRVQSAAP

SEQ ID NO: 4153 - protein, 13 aa, Artificial Sequence
  Synthetic Peptide
QSAAPARPGPAAH

SEQ ID NO: 4154 - protein, 13 aa, Artificial Sequence
  Synthetic Peptide
SGGGGSRGAPQHY

SEQ ID NO: 4155 - protein, 13 aa, Artificial Sequence
  Synthetic Peptide
AGGHGSRSQKELP

SEQ ID NO: 4156 - protein, 13 aa, Artificial Sequence
  Synthetic Peptide
GGRGGSRPGDRRT

SEQ ID NO: 4157 - protein, 13 aa, Artificial Sequence
  Synthetic Peptide
GSRPGDRRTGPPM

SEQ ID NO: 4158 - protein, 13 aa, Artificial Sequence
  Synthetic Peptide
RDGPPLRGSNMDF

SEQ ID NO: 4159 - protein, 13 aa, Artificial Sequence
  Synthetic Peptide
QWCNVVRWEFKHP

SEQ ID NO: 4160 - protein, 13 aa, Artificial Sequence
  Synthetic Peptide
DGQGMGRGSRPYR

SEQ ID NO: 4161 - protein, 13 aa, Artificial Sequence
  Synthetic Peptide
GMGRGSRPYRNRG

SEQ ID NO: 4162 - protein, 13 aa, Artificial Sequence
  Synthetic Peptide
RGSRPYRNRGHGR

SEQ ID NO: 4163 - protein, 13 aa, Artificial Sequence
  Synthetic Peptide
VPYSPFRGMAPYG

SEQ ID NO: 4164 - protein, 13 aa, Artificial Sequence
  Synthetic Peptide
RTRNRSRGQNRPT

SEQ ID NO: 4165 - protein, 13 aa, Artificial Sequence
  Synthetic Peptide
RSRGQNRPTNVKE

SEQ ID NO: 4166 - protein, 13 aa, Artificial Sequence
  Synthetic Peptide
TFGVSGRFLRGRS

SEQ ID NO: 4167 - protein, 13 aa, Artificial Sequence
  Synthetic Peptide
VSGRFLRGRSSRG

SEQ ID NO: 4168 - protein, 13 aa, Artificial Sequence
  Synthetic Peptide
GRFLRGRSSRGGF

SEQ ID NO: 4169 - protein, 13 aa, Artificial Sequence
  Synthetic Peptide
GNGTTRRNPTSHR

SEQ ID NO: 4170 - protein, 13 aa, Artificial Sequence
  Synthetic Peptide
RNPTSHRAGTGRV

SEQ ID NO: 4171 - protein, 13 aa, Artificial Sequence
  Synthetic Peptide
AAAGRARGRAEVL

SEQ ID NO: 4172 - protein, 13 aa, Artificial Sequence
  Synthetic Peptide
IRSPLWRGGGVAH

SEQ ID NO: 4173 - protein, 13 aa, Artificial Sequence
  Synthetic Peptide
RTRDLVRAGVLKE

SEQ ID NO: 4174 - protein, 13 aa, Artificial Sequence
  Synthetic Peptide
RSRGLGRGGGGPE

SEQ ID NO: 4175 - protein, 13 aa, Artificial Sequence
  Synthetic Peptide
PPLRQPRTTPPPG

SEQ ID NO: 4176 - protein, 13 aa, Artificial Sequence
  Synthetic Peptide
QTKPIFRKKAKTT

SEQ ID NO: 4177 - protein, 13 aa, Artificial Sequence
  Synthetic Peptide
RPARLTRGEADRD

SEQ ID NO: 4178 - protein, 13 aa, Artificial Sequence
  Synthetic Peptide
  misc_feature (13)..(13): Xaa can be any naturally occurring amino acid
GGFGRGRGQPPQX

SEQ ID NO: 4179 - protein, 13 aa, Artificial Sequence
  Synthetic Peptide
NVSIRGRILSGVV

SEQ ID NO: 4180 - protein, 13 aa, Artificial Sequence
  Synthetic Peptide
ARHLYLRGGAGVG

SEQ ID NO: 4181 - protein, 13 aa, Artificial Sequence
  Synthetic Peptide
GNRGGFRGGFGSG

SEQ ID NO: 4182 - protein, 13 aa, Artificial Sequence
  Synthetic Peptide
GFGSGIRGRGRGR

SEQ ID NO: 4183 - protein, 13 aa, Artificial Sequence
  Synthetic Peptide
GSGIRGRGRGRGR

SEQ ID NO: 4184 - protein, 13 aa, Artificial Sequence
  Synthetic Peptide
LYWSHPRKFGQGS

SEQ ID NO: 4185 - protein, 13 aa, Artificial Sequence
  Synthetic Peptide
VMGPPLRGRGKGR

SEQ ID NO: 4186 - protein, 13 aa, Artificial Sequence
  Synthetic Peptide
GPPLRGRGKGRGR

SEQ ID NO: 4187 - protein, 13 aa, Artificial Sequence
  Synthetic Peptide
PPPQKVRINLQQQ

SEQ ID NO: 4188 - protein, 13 aa, Artificial Sequence
  Synthetic Peptide
HRRSVSRGSYQLQ

SEQ ID NO: 4189 - protein, 13 aa, Artificial Sequence
  Synthetic Peptide
RPPMGMRPPVMSQ

SEQ ID NO: 4190 - protein, 13 aa, Artificial Sequence
  Synthetic Peptide
  misc_feature (9)..(13): Xaa can be any naturally occurring amino acid
VMSQGGRYXXXXX

SEQ ID NO: 4191 - protein, 13 aa, Artificial Sequence
  Synthetic Peptide
ASADYLRPRIPSP

SEQ ID NO: 4192 - protein, 13 aa, Artificial Sequence
  Synthetic Peptide
PGGELPRGPQAGL

SEQ ID NO: 4193 - protein, 13 aa, Artificial Sequence
  Synthetic Peptide
GAPSAPRRGRGGH

SEQ ID NO: 4194 - protein, 13 aa, Artificial Sequence
  Synthetic Peptide
GPFMPPRMKMDRD

SEQ ID NO: 4195 - protein, 13 aa, Artificial Sequence
  Synthetic Peptide
PSAQPPRTQTPPL

SEQ ID NO: 4196 - protein, 13 aa, Artificial Sequence
  Synthetic Peptide
RQTPGGRGVPLLN

SEQ ID NO: 4197 - protein, 13 aa, Artificial Sequence
  Synthetic Peptide
YIPGQGRSTYVVP

SEQ ID NO: 4198 - protein, 13 aa, Artificial Sequence
  Synthetic Peptide
SFANLGRTTLSTR

SEQ ID NO: 4199 - protein, 13 aa, Artificial Sequence
  Synthetic Peptide
RTTLSTRGPPRGG

SEQ ID NO: 4200 - protein, 13 aa, Artificial Sequence
  Synthetic Peptide
STRGPPRGGPGGE

SEQ ID NO: 4201 - protein, 13 aa, Artificial Sequence
  Synthetic Peptide
PGGELPRGPAGLG

SEQ ID NO: 4202 - protein, 13 aa, Artificial Sequence
  Synthetic Peptide
KGSDKRRGGPPGP

SEQ ID NO: 4203 - protein, 13 aa, Artificial Sequence
  Synthetic Peptide
PGPPISRGLPLVD

SEQ ID NO: 4204 - protein, 13 aa, Artificial Sequence
  Synthetic Peptide
TKVRAGRGFSLEE

SEQ ID NO: 4205 - protein, 13 aa, Artificial Sequence
  Synthetic Peptide
FESSGGRGLKKGR

SEQ ID NO: 4206 - protein, 13 aa, Artificial Sequence
  Synthetic Peptide
ELAPAGRAGKGRT

SEQ ID NO: 4207 - protein, 13 aa, Artificial Sequence
  Synthetic Peptide
NALRIARGTACNP

SEQ ID NO: 4208 - protein, 13 aa, Artificial Sequence
  Synthetic Peptide
SIAASGRGLSPPQ

SEQ ID NO: 4209 - protein, 13 aa, Artificial Sequence
  Synthetic Peptide
HENEVLRHQLFAA

SEQ ID NO: 4210 - protein, 13 aa, Artificial Sequence
  Synthetic Peptide
PQFQQHRAVYNSF

SEQ ID NO: 4211 - protein, 13 aa, Artificial Sequence
  Synthetic Peptide
KERSLGRGLFVDP

SEQ ID NO: 4212 - protein, 13 aa, Artificial Sequence
  Synthetic Peptide
EEANVGRGYIKEL

SEQ ID NO: 4213 - protein, 13 aa, Artificial Sequence
  Synthetic Peptide
LVSARRRGHSLLG

SEQ ID NO: 4214 - protein, 13 aa, Artificial Sequence
  Synthetic Peptide
RGGPNDRFPFRPS

SEQ ID NO: 4215 - protein, 13 aa, Artificial Sequence
  Synthetic Peptide
LTQGIGRSQRTLR

SEQ ID NO: 4216 - protein, 13 aa, Artificial Sequence
  Synthetic Peptide
TRLAVQRGGTFQM

SEQ ID NO: 4217 - protein, 13 aa, Artificial Sequence
  Synthetic Peptide
AVEQRSRFEYPPP

SEQ ID NO: 4218 - protein, 13 aa, Artificial Sequence
  Synthetic Peptide
RMFHPGRGLGGPR

SEQ ID NO: 4219 - protein, 13 aa, Artificial Sequence
  Synthetic Peptide
RGLGGPRARRSNM

SEQ ID NO: 4220 - protein, 13 aa, Artificial Sequence
  Synthetic Peptide
LGGPRARRSNMHF

SEQ ID NO: 4221 - protein, 13 aa, Artificial Sequence
  Synthetic Peptide
VPAHLRRGGLRPA

SEQ ID NO: 4222 - protein, 13 aa, Artificial Sequence
  Synthetic Peptide
SKKKPSRGFGDFS

SEQ ID NO: 4223 - protein, 13 aa, Artificial Sequence
  Synthetic Peptide
PHPTQIRPSYLRE

SEQ ID NO: 4224 - protein, 13 aa, Artificial Sequence
  Synthetic Peptide
AGYPHIRYISSGL

SEQ ID NO: 4225 - protein, 13 aa, Artificial Sequence
  Synthetic Peptide
YGARQPRARLTTR

SEQ ID NO: 4226 - protein, 13 aa, Artificial Sequence
  Synthetic Peptide
ARQPRARLTTRRA

SEQ ID NO: 4227 - protein, 13 aa, Artificial Sequence
  Synthetic Peptide
GGCAAGRGRELEP

SEQ ID NO: 4228 - protein, 13 aa, Artificial Sequence
  Synthetic Peptide
KASRPRRGGIPAS

SEQ ID NO: 4229 - protein, 13 aa, Artificial Sequence
  Synthetic Peptide
NRLTVPRYSIPTG

SEQ ID NO: 4230 - protein, 13 aa, Artificial Sequence
  Synthetic Peptide
QLADSPRAPLQPL

SEQ ID NO: 4231 - protein, 13 aa, Artificial Sequence
  Synthetic Peptide
RGGSGRRGGRFSA

SEQ ID NO: 4232 - protein, 13 aa, Artificial Sequence
  Synthetic Peptide
SGRRGGRFSAQGM

SEQ ID NO: 4233 - protein, 13 aa, Artificial Sequence
  Synthetic Peptide
HGYNTGRKYPPPY

SEQ ID NO: 4234 - protein, 13 aa, Artificial Sequence
  Synthetic Peptide
FTARLTRGQLQHL

SEQ ID NO: 4235 - protein, 13 aa, Artificial Sequence
  Synthetic Peptide
VARAGTRGAQQSR

SEQ ID NO: 4236 - protein, 13 aa, Artificial Sequence
  Synthetic Peptide
GAQQSRRGSWRYK

SEQ ID NO: 4237 - protein, 13 aa, Artificial Sequence
  Synthetic Peptide
PEPGGLRLELPLS

SEQ ID NO: 4238 - protein, 13 aa, Artificial Sequence
  Synthetic Peptide
LQMLQTRFPLDYY

SEQ ID NO: 4239 - protein, 13 aa, Artificial Sequence
  Synthetic Peptide
TLTSDPRLPYKVL

SEQ ID NO: 4240 - protein, 13 aa, Artificial Sequence
  Synthetic Peptide
GHCVVGRGRYPMF

SEQ ID NO: 4241 - protein, 13 aa, Artificial Sequence
  Synthetic Peptide
CVVGRGRYPMFPH

SEQ ID NO: 4242 - protein, 13 aa, Artificial Sequence
  Synthetic Peptide
GSRLMGRGYYVFD

SEQ ID NO: 4243 - protein, 13 aa, Artificial Sequence
  Synthetic Peptide
ICSSAVRALELIR

SEQ ID NO: 4244 - protein, 13 aa, Artificial Sequence
  Synthetic Peptide
FVLGKGRGAAAAG

SEQ ID NO: 4245 - protein, 13 aa, Artificial Sequence
  Synthetic Peptide
RLRAFSRGGSLES

SEQ ID NO: 4246 - protein, 13 aa, Artificial Sequence
  Synthetic Peptide
AQPKAPRFPSNII

SEQ ID NO: 4247 - protein, 13 aa, Artificial Sequence
  Synthetic Peptide
ERVARGRGLPGPA

SEQ ID NO: 4248 - protein, 13 aa, Artificial Sequence
  Synthetic Peptide
GKSLCFRPGPALP

SEQ ID NO: 4249 - protein, 13 aa, Artificial Sequence
  Synthetic Peptide
PALPSTRARQSFP

SEQ ID NO: 4250 - protein, 13 aa, Artificial Sequence
  Synthetic Peptide
RADSLPRPQGITV

SEQ ID NO: 4251 - protein, 13 aa, Artificial Sequence
  Synthetic Peptide
TVQFAGRGSSEEA

SEQ ID NO: 4252 - protein, 13 aa, Artificial Sequence
  Synthetic Peptide
GSSEEARREALRK

SEQ ID NO: 4253 - protein, 13 aa, Artificial Sequence
  Synthetic Peptide
QLGGSARGSRVLD

SEQ ID NO: 4254 - protein, 13 aa, Artificial Sequence
  Synthetic Peptide
SRSSGGRGGPGPA

SEQ ID NO: 4255 - protein, 13 aa, Artificial Sequence
  Synthetic Peptide
PAVASARGRRLPP

SEQ ID NO: 4256 - protein, 13 aa, Artificial Sequence
  Synthetic Peptide
VASARGRRLPPAG

SEQ ID NO: 4257 - protein, 13 aa, Artificial Sequence
  Synthetic Peptide
LRKKHARWTAKIK

SEQ ID NO: 4258 - protein, 13 aa, Artificial Sequence
  Synthetic Peptide
LPDGKGRGGQASR

SEQ ID NO: 4259 - protein, 13 aa, Artificial Sequence
  Synthetic Peptide
QPLQAARGTIQSS

SEQ ID NO: 4260 - protein, 13 aa, Artificial Sequence
  Synthetic Peptide
QSSPQNRFPCQPF

SEQ ID NO: 4261 - protein, 13 aa, Artificial Sequence
  Synthetic Peptide
SCSTPSRTSSGLF

SEQ ID NO: 4262 - protein, 13 aa, Artificial Sequence
  Synthetic Peptide
SSGLFPRIPLQPQ

SEQ ID NO: 4263 - protein, 13 aa, Artificial Sequence
  Synthetic Peptide
  misc_feature (1)..(1): Xaa can be any naturally occurring amino acid
XMDRVTRYPILGI

SEQ ID NO: 4264 - protein, 13 aa, Artificial Sequence
  Synthetic Peptide
TKSQTDRGASAGK

SEQ ID NO: 4265 - protein, 13 aa, Artificial Sequence
  Synthetic Peptide
EAARRPRLGLSRR

SEQ ID NO: 4266 - protein, 13 aa, Artificial Sequence
  Synthetic Peptide
RRNQIARDDYDKK

SEQ ID NO: 4267 - protein, 13 aa, Artificial Sequence
  Synthetic Peptide
RSGKRGRPSGTTK

SEQ ID NO: 4268 - protein, 13 aa, Artificial Sequence
  Synthetic Peptide
YVGEPHRGPGLPH

SEQ ID NO: 4269 - protein, 13 aa, Artificial Sequence
  Synthetic Peptide
PHGGTGRSLSSPN

SEQ ID NO: 4270 - protein, 13 aa, Artificial Sequence
  Synthetic Peptide
GGPEMRRVNSAGR

SEQ ID NO: 4271 - protein, 13 aa, Artificial Sequence
  Synthetic Peptide
LGGWLPRPWGRRK

SEQ ID NO: 4272 - protein, 13 aa, Artificial Sequence
  Synthetic Peptide
SCSLKKRMPEGPW

SEQ ID NO: 4273 - protein, 13 aa, Artificial Sequence
  Synthetic Peptide
ALSLEMRKDPSGA

SEQ ID NO: 4274 - protein, 13 aa, Artificial Sequence
  Synthetic Peptide
CASRGARLPGPVS

SEQ ID NO: 4275 - protein, 13 aa, Artificial Sequence
  Synthetic Peptide
PDPDPQRGGPGPG

SEQ ID NO: 4276 - protein, 13 aa, Artificial Sequence
  Synthetic Peptide
KDSPAGRGLSKAA

SEQ ID NO: 4277 - protein, 13 aa, Artificial Sequence
  Synthetic Peptide
GSGGPGRGGRRAT

SEQ ID NO: 4278 - protein, 13 aa, Artificial Sequence
  Synthetic Peptide
VGIPAARLPSAPT

SEQ ID NO: 4279 - protein, 13 aa, Artificial Sequence
  Synthetic Peptide
SAPTPLRPGFSRT

SEQ ID NO: 4280 - protein, 13 aa, Artificial Sequence
  Synthetic Peptide
PARGTPRSQSFAL

SEQ ID NO: 4281 - protein, 13 aa, Artificial Sequence
  Synthetic Peptide
SQSFALRARRKGP

SEQ ID NO: 4282 - protein, 13 aa, Artificial Sequence
  Synthetic Peptide
PAGSAARGRVSVH

SEQ ID NO: 4283 - protein, 13 aa, Artificial Sequence
  Synthetic Peptide
WLPSFGRVWNNGR

SEQ ID NO: 4284 - protein, 13 aa, Artificial Sequence
  Synthetic Peptide
GASKGGRTPPQQG

SEQ ID NO: 4285 - protein, 13 aa, Artificial Sequence
  Synthetic Peptide
PPQQGGRAGMGRA

SEQ ID NO: 4286 - protein, 13 aa, Artificial Sequence
  Synthetic Peptide
GRAGMGRASRSWE

SEQ ID NO: 4287 - protein, 13 aa, Artificial Sequence
  Synthetic Peptide
GMGRASRSWEGSP

SEQ ID NO: 4288 - protein, 13 aa, Artificial Sequence
  Synthetic Peptide
SPGEQPRGGGAGG

SEQ ID NO: 4289 - protein, 13 aa, Artificial Sequence
  Synthetic Peptide
GGGAGGRGRRGRG

SEQ ID NO: 4290 - protein, 13 aa, Artificial Sequence
  Synthetic Peptide
GAGGRGRRGRGRG

SEQ ID NO: 4291 - protein, 13 aa, Artificial Sequence
  Synthetic Peptide
AGGRGRRGRGRGS

SEQ ID NO: 4292 - protein, 13 aa, Artificial Sequence
  Synthetic Peptide
GRGRRGRGRGSPH

SEQ ID NO: 4293 - protein, 13 aa, Artificial Sequence
  Synthetic Peptide
GRRGRGRGSPHLS

SEQ ID NO: 4294 - protein, 13 aa, Artificial Sequence
  Synthetic Peptide
ARCVHPRGGVIQS

SEQ ID NO: 4295 - protein, 13 aa, Artificial Sequence
  Synthetic Peptide
REPALLRGSWRSR

SEQ ID NO: 4296 - protein, 13 aa, Artificial Sequence
  Synthetic Peptide
  misc_feature (1)..(3): Xaa can be any naturally occurring amino acid
XXXMGGRGADAGS

SEQ ID NO: 4297 - protein, 13 aa, Artificial Sequence
  Synthetic Peptide
PSVPSLRGAAPRS

SEQ ID NO: 4298 - protein, 13 aa, Artificial Sequence
  Synthetic Peptide
PAPSPTRGFGKMF

SEQ ID NO: 4299 - protein, 13 aa, Artificial Sequence
  Synthetic Peptide
APVAAPRTNGVAM

SEQ ID NO: 4300 - protein, 13 aa, Artificial Sequence
  Synthetic Peptide
NQQLSIRVPLRSS

SEQ ID NO: 4301 - protein, 13 aa, Artificial Sequence
  Synthetic Peptide
LSSPGPRLVFNRV

SEQ ID NO: 4302 - protein, 13 aa, Artificial Sequence
  Synthetic Peptide
PNENKFRGFMQKF

SEQ ID NO: 4303 - protein, 13 aa, Artificial Sequence
  Synthetic Peptide
KLDLFGRPPAPGV

SEQ ID NO: 4304 - protein, 13 aa, Artificial Sequence
  Synthetic Peptide
RPPASGRGERAPP

SEQ ID NO: 4305 - protein, 13 aa, Artificial Sequence
  Synthetic Peptide
RSGPSARGTPRAP

SEQ ID NO: 4306 - protein, 13 aa, Artificial Sequence
  Synthetic Peptide
SASPLFRGRKRLS

SEQ ID NO: 4307 - protein, 13 aa, Artificial Sequence
  Synthetic Peptide
YVPDIVRCVPPFR

SEQ ID NO: 4308 - protein, 13 aa, Artificial Sequence
  Synthetic Peptide
MSHPSRRGFQARL

SEQ ID NO: 4309 - protein, 13 aa, Artificial Sequence
  Synthetic Peptide
HTTDDLRMSSLPP

SEQ ID NO: 4310 - protein, 13 aa, Artificial Sequence
  Synthetic Peptide
HRAAQSRGASLLQ

SEQ ID NO: 4311 - protein, 13 aa, Artificial Sequence
  Synthetic Peptide
MNDLGTRCSFYAT

SEQ ID NO: 4312 - protein, 13 aa, Artificial Sequence
  Synthetic Peptide
LHLSGVRYPPELS

SEQ ID NO: 4313 - protein, 13 aa, Artificial Sequence
  Synthetic Peptide
SMLHYIRGAAPKD

SEQ ID NO: 4314 - protein, 13 aa, Artificial Sequence
  Synthetic Peptide
RLALGSRGGYNGR

SEQ ID NO: 4315 - protein, 13 aa, Artificial Sequence
  Synthetic Peptide
YQLPPGRGGPPPG

SEQ ID NO: 4316 - protein, 13 aa, Artificial Sequence
  Synthetic Peptide
RDAQGPRGGGPGF

SEQ ID NO: 4317 - protein, 13 aa, Artificial Sequence
  Synthetic Peptide
VSAVAVRVAQAGD

SEQ ID NO: 4318 - protein, 13 aa, Artificial Sequence
  Synthetic Peptide
QTKPIFRKKGQVV

SEQ ID NO: 4319 - protein, 13 aa, Artificial Sequence
  Synthetic Peptide
GPGSTWRRLLASR

SEQ ID NO: 4320 - protein, 13 aa, Artificial Sequence
  Synthetic Peptide
PGSTWRRLLASRF

SEQ ID NO: 4321 - protein, 13 aa, Artificial Sequence
  Synthetic Peptide
HSRRKWRGSWRTR

SEQ ID NO: 4322 - protein, 13 aa, Artificial Sequence
  Synthetic Peptide
GVAVSGRDQPAAR

SEQ ID NO: 4323 - protein, 13 aa, Artificial Sequence
  Synthetic Peptide
SRNSSPRAFRGRG

SEQ ID NO: 4324 - protein, 13 aa, Artificial Sequence
  Synthetic Peptide
RARRPQRHGGSGT

SEQ ID NO: 4325 - protein, 13 aa, Artificial Sequence
  Synthetic Peptide
AHAGAARQVASGF

SEQ ID NO: 4326 - protein, 13 aa, Artificial Sequence
  Synthetic Peptide
CGGGIGRGKELKL

SEQ ID NO: 4327 - protein, 13 aa, Artificial Sequence
  Synthetic Peptide
SQFQGHRVSARAT

SEQ ID NO: 4328 - protein, 13 aa, Artificial Sequence
  Synthetic Peptide
GHRVSARATESVP

SEQ ID NO: 4329 - protein, 13 aa, Artificial Sequence
  Synthetic Peptide
RTVGTQRRLERHP

SEQ ID NO: 4330 - protein, 13 aa, Artificial Sequence
  Synthetic Peptide
MARRASRGPIAFW

SEQ ID NO: 4331 - protein, 13 aa, Artificial Sequence
  Synthetic Peptide
DWGYSGRGGYQHV

SEQ ID NO: 4332 - protein, 13 aa, Artificial Sequence
  Synthetic Peptide
QLLNCGRGNSCGA

SEQ ID NO: 4333 - protein, 13 aa, Artificial Sequence
  Synthetic Peptide
RGPPGSRGPLIPP

SEQ ID NO: 4334 - protein, 13 aa, Artificial Sequence
  Synthetic Peptide
PPPPWGRGPIRRG

SEQ ID NO: 4335 - protein, 13 aa, Artificial Sequence
  Synthetic Peptide
WGRGPIRRGLGPR

SEQ ID NO: 4336 - protein, 13 aa, Artificial Sequence
  Synthetic Peptide
EFTFRGRPAGGNG

SEQ ID NO: 4337 - protein, 13 aa, Artificial Sequence
  Synthetic Peptide
LSVGAPRRIPPPG

SEQ ID NO: 4338 - protein, 13 aa, Artificial Sequence
  Synthetic Peptide
QSALKLRQQLQAK

SEQ ID NO: 4339 - protein, 13 aa, Artificial Sequence
  Synthetic Peptide
TYNYNMRGGAYPP

SEQ ID NO: 4340 - protein, 13 aa, Artificial Sequence
  Synthetic Peptide
GGAYPPRYFYPFP

SEQ ID NO: 4341 - protein, 13 aa, Artificial Sequence
  Synthetic Peptide
FSTLAVRMPNRTR

SEQ ID NO: 4342 - protein, 13 aa, Artificial Sequence
  Synthetic Peptide
MPNRTRRPGTQMV

SEQ ID NO: 4343 - protein, 13 aa, Artificial Sequence
  Synthetic Peptide
PGTQMVRTFCPPP

SEQ ID NO: 4344 - protein, 13 aa, Artificial Sequence
  Synthetic Peptide
PGQGDSRYPLLGQ

SEQ ID NO: 4345 - protein, 13 aa, Artificial Sequence
  Synthetic Peptide
YTAFVTRGGRLEL

SEQ ID NO: 4346 - protein, 13 aa, Artificial Sequence
  Synthetic Peptide
FVTRGGRLELSGS

SEQ ID NO: 4347 - protein, 13 aa, Artificial Sequence
  Synthetic Peptide
NGPAAGRGTPKGK

SEQ ID NO: 4348 - protein, 13 aa, Artificial Sequence
  Synthetic Peptide
WSDAILRTRFLEG

SEQ ID NO: 4349 - protein, 13 aa, Artificial Sequence
  Synthetic Peptide
GRAPLSRGRDSYG

SEQ ID NO: 4350 - protein, 13 aa, Artificial Sequence
  Synthetic Peptide
APLSRGRDSYGGP

SEQ ID NO: 4351 - protein, 13 aa, Artificial Sequence
  Synthetic Peptide
APMPMKRGPPPRR

SEQ ID NO: 4352 - protein, 13 aa, Artificial Sequence
  Synthetic Peptide
APMPRKRGPPPRH

SEQ ID NO: 4353 - protein, 13 aa, Artificial Sequence
  Synthetic Peptide
PGLSRVRESLTLP

SEQ ID NO: 4354 - protein, 13 aa, Artificial Sequence
  Synthetic Peptide
RSGIILRSPRPDF

SEQ ID NO: 4355 - protein, 13 aa, Artificial Sequence
  Synthetic Peptide
IILRSPRPDFRPR

SEQ ID NO: 4356 - protein, 13 aa, Artificial Sequence
  Synthetic Peptide
SPRPDFRPREPFL

SEQ ID NO: 4357 - protein, 13 aa, Artificial Sequence
  Synthetic Peptide
RPDFRPREPFLSR

SEQ ID NO: 4358 - protein, 13 aa, Artificial Sequence
  Synthetic Peptide
REPFLSRDPFHSL

SEQ ID NO: 4359 - protein, 13 aa, Artificial Sequence
  Synthetic Peptide
PFFAPKRPFFPPR

SEQ ID NO: 4360 - protein, 13 aa, Artificial Sequence
  Synthetic Peptide
  misc_feature (9)..(13): Xaa can be any naturally occurring amino acid
RPFFPPRYXXXXX

SEQ ID NO: 4361 - protein, 13 aa, Artificial Sequence
  Synthetic Peptide
SQTHTQRGMGLGF

SEQ ID NO: 4362 - protein, 13 aa, Artificial Sequence
  Synthetic Peptide
GMGVARRTQRQFP

SEQ ID NO: 4363 - protein, 13 aa, Artificial Sequence
  Synthetic Peptide
IGGVSPRHALTSP

SEQ ID NO: 4364 - protein, 13 aa, Artificial Sequence
  Synthetic Peptide
APLQGDRGAGPPL

SEQ ID NO: 4365 - protein, 13 aa, Artificial Sequence
  Synthetic Peptide
VLPGNRRGGQGYR

SEQ ID NO: 4366 - protein, 13 aa, Artificial Sequence
  Synthetic Peptide
RGGQGYRPQGQKS

SEQ ID NO: 4367 - protein, 13 aa, Artificial Sequence
  Synthetic Peptide
KRWEMDRGRGRLC

SEQ ID NO: 4368 - protein, 13 aa, Artificial Sequence
  Synthetic Peptide
ALGVSDRGSWRDA

SEQ ID NO: 4369 - protein, 13 aa, Artificial Sequence
  Synthetic Peptide
AKPAVGRGVQHTD

SEQ ID NO: 4370 - protein, 13 aa, Artificial Sequence
  Synthetic Peptide
FGDSLARGGKGFL

SEQ ID NO: 4371 - protein, 13 aa, Artificial Sequence
  Synthetic Peptide
GGKGFLRGVVGGV

SEQ ID NO: 4372 - protein, 13 aa, Artificial Sequence
  Synthetic Peptide
PVAGPGRGGRVGT

SEQ ID NO: 4373 - protein, 13 aa, Artificial Sequence
  Synthetic Peptide
VHGPSPRGKGYSS

SEQ ID NO: 4374 - protein, 13 aa, Artificial Sequence
  Synthetic Peptide
TWGMNCRFIHPGV

SEQ ID NO: 4375 - protein, 13 aa, Artificial Sequence
  Synthetic Peptide
TLPIGARYAPPPS

SEQ ID NO: 4376 - protein, 13 aa, Artificial Sequence
  Synthetic Peptide
GRPPAVRGPTPGP

SEQ ID NO: 4377 - protein, 13 aa, Artificial Sequence
  Synthetic Peptide
PGVPSRRPPAAPS

SEQ ID NO: 4378 - protein, 13 aa, Artificial Sequence
  Synthetic Peptide
PPAAPSRPTIIRP

SEQ ID NO: 4379 - protein, 13 aa, Artificial Sequence
  Synthetic Peptide
SLGPTRRSLGGPL

SEQ ID NO: 4380 - protein, 13 aa, Artificial Sequence
  Synthetic Peptide
IRQRSMRYQQNRL

SEQ ID NO: 4381 - protein, 13 aa, Artificial Sequence
  Synthetic Peptide
AARPVSRGGVGLT

SEQ ID NO: 4382 - protein, 13 aa, Artificial Sequence
  Synthetic Peptide
TARPGSRGCPIGT

SEQ ID NO: 4383 - protein, 13 aa, Artificial Sequence
  Synthetic Peptide
LHLKGPKVKGDVD

SEQ ID NO: 4384 - protein, 13 aa, Artificial Sequence
  Synthetic Peptide
LNLKGPKVKGDMD

SEQ ID NO: 4385 - protein, 13 aa, Artificial Sequence
  Synthetic Peptide
LNLKGPKIKGDMD

SEQ ID NO: 4386 - protein, 13 aa, Artificial Sequence
  Synthetic Peptide
QICHRSKQQGFNY

SEQ ID NO: 4387 - protein, 13 aa, Artificial Sequence
  Synthetic Peptide
RRALSLKAHQSES

SEQ ID NO: 4388 - protein, 13 aa, Artificial Sequence
  Synthetic Peptide
ELAVIAKRLEERA

SEQ ID NO: 4389 - protein, 13 aa, Artificial Sequence
  Synthetic Peptide
PEDVLLKHQASIN

SEQ ID NO: 4390 - protein, 13 aa, Artificial Sequence
  Synthetic Peptide
LKHGTLKGLSSSS

SEQ ID NO: 4391 - protein, 13 aa, Artificial Sequence
  Synthetic Peptide
TDTITMKANSFES

SEQ ID NO: 4392 - protein, 13 aa, Artificial Sequence
  Synthetic Peptide
GKQDLDKLIKVNP

SEQ ID NO: 4393 - protein, 13 aa, Artificial Sequence
  Synthetic Peptide
PAGSGLKRSSGMS

SEQ ID NO: 4394 - protein, 13 aa, Artificial Sequence
  Synthetic Peptide
TYSSSLKRSSPRT

SEQ ID NO: 4395 - protein, 13 aa, Artificial Sequence
  Synthetic Peptide
SVPNLKKTNAQAA

SEQ ID NO: 4396 - protein, 13 aa, Artificial Sequence
  Synthetic Peptide
GSQPNQKLGHPEA

SEQ ID NO: 4397 - protein, 13 aa, Artificial Sequence
  Synthetic Peptide
GLGMQLKGPLGPG

SEQ ID NO: 4398 - protein, 13 aa, Artificial Sequence
  Synthetic Peptide
NMERIMKAQAYQT

SEQ ID NO: 4399 - protein, 13 aa, Artificial Sequence
  Synthetic Peptide
SNQPLLKSPAPPL

SEQ ID NO: 4400 - protein, 13 aa, Artificial Sequence
  Synthetic Peptide
TRSSRSKTGSLQL

SEQ ID NO: 4401 - protein, 13 aa, Artificial Sequence
  Synthetic Peptide
TAKNPAKSNTSKP

SEQ ID NO: 4402 - protein, 13 aa, Artificial Sequence
  Synthetic Peptide
AVSAAVKGLRSHE

SEQ ID NO: 4403 - protein, 13 aa, Artificial Sequence
  Synthetic Peptide
LGTKGLKVNLFPG

SEQ ID NO: 4404 - protein, 13 aa, Artificial Sequence
  Synthetic Peptide
SHSGLSKGSVLSE

SEQ ID NO: 4405 - protein, 13 aa, Artificial Sequence
  Synthetic Peptide
NMERIMKAQALRD

SEQ ID NO: 4406 - protein, 13 aa, Artificial Sequence
  Synthetic Peptide
EIEAKIKELTSTC

SEQ ID NO: 4407 - protein, 13 aa, Artificial Sequence
  Synthetic Peptide
KLSSEDKETMEKA

SEQ ID NO: 4408 - protein, 13 aa, Artificial Sequence
  Synthetic Peptide
ATVEDEKLQGKIN

SEQ ID NO: 4409 - protein, 13 aa, Artificial Sequence
  Synthetic Peptide
AAMFGPKGFGRGG

SEQ ID NO: 4410 - protein, 13 aa, Artificial Sequence
  Synthetic Peptide
STGGVKKPHRYRP

SEQ ID NO: 4411 - protein, 13 aa, Artificial Sequence
  Synthetic Peptide
MKTPFGKTPGQRS

SEQ ID NO: 4412 - protein, 13 aa, Artificial Sequence
  Synthetic Peptide
IAPKREKTHGEVE

SEQ ID NO: 4413 - protein, 13 aa, Artificial Sequence
  Synthetic Peptide
HKNPALKAQSGPV

SEQ ID NO: 4414 - protein, 13 aa, Artificial Sequence
  Synthetic Peptide
  misc_feature (1)..(2): Xaa can be any naturally occurring amino acid
XXMPILKQLVSSS

SEQ ID NO: 4415 - protein, 13 aa, Artificial Sequence
  Synthetic Peptide
FDEGKLKAGQSVI

SEQ ID NO: 4416 - protein, 13 aa, Artificial Sequence
  Synthetic Peptide
PENLRLKQQSELQ

SEQ ID NO: 4417 - protein, 13 aa, Artificial Sequence
  Synthetic Peptide
STQTVAKTTTAAA

SEQ ID NO: 4418 - protein, 13 aa, Artificial Sequence
  Synthetic Peptide
QSKCGSKDNIKHV

SEQ ID NO: 4419 - protein, 13 aa, Artificial Sequence
  Synthetic Peptide
ILSPRSKESVPEF

SEQ ID NO: 4420 - protein, 13 aa, Artificial Sequence
  Synthetic Peptide
GLLVLPKNKKRSR

SEQ ID NO: 4421 - protein, 13 aa, Artificial Sequence
  Synthetic Peptide
AFQSQYKSHFVAA

SEQ ID NO: 4422 - protein, 13 aa, Artificial Sequence
  Synthetic Peptide
LPGHAAKTLPGGA

SEQ ID NO: 4423 - protein, 13 aa, Artificial Sequence
  Synthetic Peptide
ARKTMSKPGNGQP

SEQ ID NO: 4424 - protein, 13 aa, Artificial Sequence
  Synthetic Peptide
RPDYCMKRHLSDM

SEQ ID NO: 4425 - protein, 13 aa, Artificial Sequence
  Synthetic Peptide
SQADALKYVGIER

SEQ ID NO: 4426 - protein, 13 aa, Artificial Sequence
  Synthetic Peptide
WAAHCRKIQLKKD

SEQ ID NO: 4427 - protein, 13 aa, Artificial Sequence
  Synthetic Peptide
RKIQLKKDGSSNH

SEQ ID NO: 4428 - protein, 13 aa, Artificial Sequence
  Synthetic Peptide
  misc_feature (9)..(13): Xaa can be any naturally occurring amino acid
PINGNGKQXXXXX

SEQ ID NO: 4429 - protein, 13 aa, Artificial Sequence
  Synthetic Peptide
RLKANLKGTLQAG

SEQ ID NO: 4430 - protein, 13 aa, Artificial Sequence
  Synthetic Peptide
TRGFALKSTHGIA

SEQ ID NO: 4431 - protein, 13 aa, Artificial Sequence
  Synthetic Peptide
THGIAIKSTNMAS

SEQ ID NO: 4432 - protein, 13 aa, Artificial Sequence
  Synthetic Peptide
SSPKRLKAQKEDD

SEQ ID NO: 4433 - protein, 13 aa, Artificial Sequence
  Synthetic Peptide
KLRGWLKSNVSDA

SEQ ID NO: 4434 - protein, 13 aa, Artificial Sequence
  Synthetic Peptide
ETERMLKTAVSEK

SEQ ID NO: 4435 - protein, 13 aa, Artificial Sequence
  Synthetic Peptide
EKLEKLKSQADQF

SEQ ID NO: 4436 - protein, 13 aa, Artificial Sequence
  Synthetic Peptide
KECGSLKSQNRVP

SEQ ID NO: 4437 - protein, 13 aa, Artificial Sequence
  Synthetic Peptide
RPISKSKTDLPEE

SEQ ID NO: 4438 - protein, 13 aa, Artificial Sequence
  Synthetic Peptide
HVLKQGKTLAFTS

SEQ ID NO: 4439 - protein, 13 aa, Artificial Sequence
  Synthetic Peptide
AQEEYVKRALANS

SEQ ID NO: 4440 - protein, 13 aa, Artificial Sequence
  Synthetic Peptide
PNIMKAKKKKIEV

SEQ ID NO: 4441 - protein, 13 aa, Artificial Sequence
  Synthetic Peptide
TLPNIMKAKKKKI

SEQ ID NO: 4442 - protein, 13 aa, Artificial Sequence
  Synthetic Peptide
ESGHSLKSSLSHA

SEQ ID NO: 4443 - protein, 13 aa, Artificial Sequence
  Synthetic Peptide
MSSRKSKSNSLIH

SEQ ID NO: 4444 - protein, 13 aa, Artificial Sequence
  Synthetic Peptide
GVVGLFKAQNAPS

SEQ ID NO: 4445 - protein, 13 aa, Artificial Sequence
  Synthetic Peptide
MCENFYKYSKPKK

SEQ ID NO: 4446 - protein, 13 aa, Artificial Sequence
  Synthetic Peptide
PWCGHCKRLAPEY

SEQ ID NO: 4447 - protein, 13 aa, Artificial Sequence
  Synthetic Peptide
NARRKLKGAILTT

SEQ ID NO: 4448 - protein, 13 aa, Artificial Sequence
  Synthetic Peptide
RERRRLKQSQEEM

SEQ ID NO: 4449 - protein, 13 aa, Artificial Sequence
  Synthetic Peptide
RGSKGAKDGALTL

SEQ ID NO: 4450 - protein, 13 aa, Artificial Sequence
  Synthetic Peptide
SPRTSMKIQQNQS

SEQ ID NO: 4451 - protein, 13 aa, Artificial Sequence
  Synthetic Peptide
ALVELVKHKPKAT

SEQ ID NO: 4452 - protein, 13 aa, Artificial Sequence
  Synthetic Peptide
EKRLQVKQNQHEE

SEQ ID NO: 4453 - protein, 13 aa, Artificial Sequence
  Synthetic Peptide
AKRNSLKELWLVI

SEQ ID NO: 4454 - protein, 13 aa, Artificial Sequence
  Synthetic Peptide
QAVTYAKVKHSRP

SEQ ID NO: 4455 - protein, 13 aa, Artificial Sequence
  Synthetic Peptide
NPLEIVKIRLQVA

SEQ ID NO: 4456 - protein, 13 aa, Artificial Sequence
  Synthetic Peptide
GFSVTLKEDGVRG

SEQ ID NO: 4457 - protein, 13 aa, Artificial Sequence
  Synthetic Peptide
TADKQYKGIIDCV

SEQ ID NO: 4458 - protein, 13 aa, Artificial Sequence
  Synthetic Peptide
LAADVGKAGAERE

SEQ ID NO: 4459 - protein, 13 aa, Artificial Sequence
  Synthetic Peptide
AADKQYKGIVDCI

SEQ ID NO: 4460 - protein, 13 aa, Artificial Sequence
  Synthetic Peptide
ADLDLMKSHRFED

SEQ ID NO: 4461 - protein, 13 aa, Artificial Sequence
  Synthetic Peptide
HRIPNFKGASHAA

SEQ ID NO: 4462 - protein, 13 aa, Artificial Sequence
  Synthetic Peptide
ERACWMKSSLEEG

SEQ ID NO: 4463 - protein, 13 aa, Artificial Sequence
  Synthetic Peptide
INTLFQKDRHTLA

SEQ ID NO: 4464 - protein, 13 aa, Artificial Sequence
  Synthetic Peptide
EESMKWKKLTNAQ

SEQ ID NO: 4465 - protein, 13 aa, Artificial Sequence
  Synthetic Peptide
ESMKWKKLTNAQR

SEQ ID NO: 4466 - protein, 13 aa, Artificial Sequence
  Synthetic Peptide
SGLGRKKQGIVTP

SEQ ID NO: 4467 - protein, 13 aa, Artificial Sequence
  Synthetic Peptide
TERGRMKDHRPAL

SEQ ID NO: 4468 - protein, 13 aa, Artificial Sequence
  Synthetic Peptide
ISNVQPKTSNFVP

SEQ ID NO: 4469 - protein, 13 aa, Artificial Sequence
  Synthetic Peptide
ERRRRWKEPGSGG

SEQ ID NO: 4470 - protein, 13 aa, Artificial Sequence
  Synthetic Peptide
CSRLHNKPTFSQT

SEQ ID NO: 4471 - protein, 13 aa, Artificial Sequence
  Synthetic Peptide
CSRLHNKPTFSQT

SEQ ID NO: 4472 - protein, 13 aa, Artificial Sequence
  Synthetic Peptide
MERMSLKHQNSGK

SEQ ID NO: 4473 - protein, 13 aa, Artificial Sequence
  Synthetic Peptide
AKERYMKMHLAGK

SEQ ID NO: 4474 - protein, 13 aa, Artificial Sequence
  Synthetic Peptide
  misc_feature (1)..(5): Xaa can be any naturally occurring amino acid
XXXXXMKETIMNQ

SEQ ID NO: 4475 - protein, 13 aa, Artificial Sequence
  Synthetic Peptide
TIMNQEKLAKLQA

SEQ ID NO: 4476 - protein, 13 aa, Artificial Sequence
  Synthetic Peptide
ANTQGKKAKRKAR

SEQ ID NO: 4477 - protein, 13 aa, Artificial Sequence
  Synthetic Peptide
SAPLKSKMIYASS

SEQ ID NO: 4478 - protein, 13 aa, Artificial Sequence
  Synthetic Peptide
DRGANLKDYYSRK

SEQ ID NO: 4479 - protein, 13 aa, Artificial Sequence
  Synthetic Peptide
AAQAKSKQAILAA

SEQ ID NO: 4480 - protein, 13 aa, Artificial Sequence
  Synthetic Peptide
KPASGVKEEWYAR

SEQ ID NO: 4481 - protein, 13 aa, Artificial Sequence
  Synthetic Peptide
KRGRKSKAELLLL

SEQ ID NO: 4482 - protein, 13 aa, Artificial Sequence
  Synthetic Peptide
KTITLVKSPISVP

SEQ ID NO: 4483 - protein, 13 aa, Artificial Sequence
  Synthetic Peptide
NQNGKSKGYAFIE

SEQ ID NO: 4484 - protein, 13 aa, Artificial Sequence
  Synthetic Peptide
AHSVLKKTLQDQT

SEQ ID NO: 4485 - protein, 13 aa, Artificial Sequence
  Synthetic Peptide
TYYQRLKHMVDDK

SEQ ID NO: 4486 - protein, 13 aa, Artificial Sequence
  Synthetic Peptide
VYYQKLKHMVLDK

SEQ ID NO: 4487 - protein, 13 aa, Artificial Sequence
  Synthetic Peptide
PRSQQLKALCEKH

SEQ ID NO: 4488 - protein, 13 aa, Artificial Sequence
  Synthetic Peptide
AESHNMKNQQMDP

SEQ ID NO: 4489 - protein, 13 aa, Artificial Sequence
  Synthetic Peptide
TQTIAVKESLTTD

SEQ ID NO: 4490 - protein, 13 aa, Artificial Sequence
  Synthetic Peptide
GAGRNSKQQLSAE

SEQ ID NO: 4491 - protein, 13 aa, Artificial Sequence
  Synthetic Peptide
ERSPALKSPLQSV

SEQ ID NO: 4492 - protein, 13 aa, Artificial Sequence
  Synthetic Peptide
QPITAVKDMPVRS

SEQ ID NO: 4493 - protein, 13 aa, Artificial Sequence
  Synthetic Peptide
AEGTKSKWGMIPR

SEQ ID NO: 4494 - protein, 13 aa, Artificial Sequence
  Synthetic Peptide
AAARGIKRKMMQP

SEQ ID NO: 4495 - protein, 13 aa, Artificial Sequence
  Synthetic Peptide
  misc_feature (1)..(2): Xaa can be any naturally occurring amino acid
XXMGKEKTHINIV

SEQ ID NO: 4496 - protein, 13 aa, Artificial Sequence
  Synthetic Peptide
EAAEMGKGSFKYA

SEQ ID NO: 4497 - protein, 13 aa, Artificial Sequence
  Synthetic Peptide
YAWVLDKLKAERE

SEQ ID NO: 4498 - protein, 13 aa, Artificial Sequence
  Synthetic Peptide
WKFETSKYYVTII

SEQ ID NO: 4499 - protein, 13 aa, Artificial Sequence
  Synthetic Peptide
IDISLWKFETTKY

SEQ ID NO: 4500 - protein, 13 aa, Artificial Sequence
  Synthetic Peptide
WKFETTKYYITII

SEQ ID NO: 4501 - protein, 13 aa, Artificial Sequence
  Synthetic Peptide
EPAYSEKRYDEIV

SEQ ID NO: 4502 - protein, 13 aa, Artificial Sequence
  Synthetic Peptide
VKNVSVKDIRRGN

SEQ ID NO: 4503 - protein, 13 aa, Artificial Sequence
  Synthetic Peptide
KLVEGLKRLAKSD

SEQ ID NO: 4504 - protein, 13 aa, Artificial Sequence
  Synthetic Peptide
MGGKFMKSQGLSQ

SEQ ID NO: 4505 - protein, 13 aa, Artificial Sequence
  Synthetic Peptide
GALGKLKHSQDPG

SEQ ID NO: 4506 - protein, 13 aa, Artificial Sequence
  Synthetic Peptide
  misc_feature (1)..(2): Xaa can be any naturally occurring amino acid
XXMAKSKNHTTHN

SEQ ID NO: 4507 - protein, 13 aa, Artificial Sequence
  Synthetic Peptide
KRRYDRKQSGYGG

SEQ ID NO: 4508 - protein, 13 aa, Artificial Sequence
  Synthetic Peptide
TKPIFRKKAKTTK

SEQ ID NO: 4509 - protein, 13 aa, Artificial Sequence
  Synthetic Peptide
KVFGALKGAVDGG

SEQ ID NO: 4510 - protein, 13 aa, Artificial Sequence
  Synthetic Peptide
EHKVYLKSQLNCL

SEQ ID NO: 4511 - protein, 13 aa, Artificial Sequence
  Synthetic Peptide
VRLPSLKHQSNKG

SEQ ID NO: 4512 - protein, 13 aa, Artificial Sequence
  Synthetic Peptide
FFCHFCKGEVSPK

SEQ ID NO: 4513 - protein, 13 aa, Artificial Sequence
  Synthetic Peptide
HRVQPVKDTAHDF

SEQ ID NO: 4514 - protein, 13 aa, Artificial Sequence
  Synthetic Peptide
TLSSEEKGKKTKK

SEQ ID NO: 4515 - protein, 13 aa, Artificial Sequence
  Synthetic Peptide
SPHKSLKCLAAET

SEQ ID NO: 4516 - protein, 13 aa, Artificial Sequence
  Synthetic Peptide
MISTSIKTARKSK

SEQ ID NO: 4517 - protein, 13 aa, Artificial Sequence
  Synthetic Peptide
GDVPPVKHPLQKY

SEQ ID NO: 4518 - protein, 13 aa, Artificial Sequence
  Synthetic Peptide
VKHPLQKYAPSSL

SEQ ID NO: 4519 - protein, 13 aa, Artificial Sequence
  Synthetic Peptide
  misc_feature (12)..(13): Xaa can be any naturally occurring amino acid
YKMMFVKSSGSXX

SEQ ID NO: 4520 - protein, 13 aa, Artificial Sequence
  Synthetic Peptide
LYRHFLKSPNFDG

SEQ ID NO: 4521 - protein, 13 aa, Artificial Sequence
  Synthetic Peptide
LNQQSLKRSANQM

SEQ ID NO: 4522 - protein, 13 aa, Artificial Sequence
  Synthetic Peptide
AHTVIIKGTQVYS

SEQ ID NO: 4523 - protein, 13 aa, Artificial Sequence
  Synthetic Peptide
  misc_feature (1)..(4): Xaa can be any naturally occurring amino acid
XXXXMSKPHSEAG

SEQ ID NO: 4524 - protein, 13 aa, Artificial Sequence
  Synthetic Peptide
PPVRTLKSQSSLS

SEQ ID NO: 4525 - protein, 13 aa, Artificial Sequence
  Synthetic Peptide
IAQLCEKAGLLQR

SEQ ID NO: 4526 - protein, 21 aa, Artificial Sequence
  Synthetic Peptide
NFADEDEAQAFRALVQEKIQK

SEQ ID NO: 4527 - protein, 16 aa, Artificial Sequence
  Synthetic Peptide
EVFQIASNDHDAAINR

SEQ ID NO: 4528 - protein, 15 aa, Artificial Sequence
  Synthetic Peptide
DYSLSPSQMNGHQRG

SEQ ID NO: 4529 - protein, 18 aa, Artificial Sequence
  Synthetic Peptide
TSVHVPLEARVSNAESST

SEQ ID NO: 4530 - protein, 12 aa, Artificial Sequence
  Synthetic Peptide
LIWSREINGPPR

SEQ ID NO: 4531 - protein, 35 aa, Artificial Sequence
  Synthetic Peptide
ARPGDVEFEDFSQPMNRAPSDSSLGTPSDGRPELR

SEQ ID NO: 4532 - protein, 16 aa, Artificial Sequence
  Synthetic Peptide
RRGRMSGNPDVLEYYR

SEQ ID NO: 4533 - protein, 14 aa, Artificial Sequence
  Synthetic Peptide
LLDDDLVLGVYIHR

SEQ ID NO: 4534 - protein, 18 aa, Artificial Sequence
  Synthetic Peptide
MNGGGTGCNHELEMIRQK

SEQ ID NO: 4535 - protein, 20 aa, Artificial Sequence
  Synthetic Peptide
PVSVAGSPLSPGPVRAPLSR

SEQ ID NO: 4536 - protein, 18 aa, Artificial Sequence
  Synthetic Peptide
GTPGPPPAHGAALQPHPR

SEQ ID NO: 4537 - protein, 25 aa, Artificial Sequence
  Synthetic Peptide
TGRGNGPLPLGGSGLMEEMSALLAR

SEQ ID NO: 4538 - protein, 21 aa, Artificial Sequence
  Synthetic Peptide
EDPGSSLKEMTDARSKYSGTR

SEQ ID NO: 4539 - protein, 28 aa, Artificial Sequence
  Synthetic Peptide
GNPQGKEDQEGSGGDYMPMNNWGSGNGR

SEQ ID NO: 4540 - protein, 42 aa, Artificial Sequence
  Synthetic Peptide
AQAGSPLHGDTSPAATPTQRSPRTSFGSLTDSSEEALEGMVR

SEQ ID NO: 4541 - protein, 9 aa, Artificial Sequence
  Synthetic Peptide
FHARTGMIE

SEQ ID NO: 4542 - protein, 36 aa, Artificial Sequence
  Synthetic Peptide
TPLLGDGPRAPFNQEGQSTGPPPLIPGLGQQGAQGR

SEQ ID NO: 4543 - protein, 33 aa, Artificial Sequence
  Synthetic Peptide
SQSLPIELTSVVPESTEDILLKGFTSLGMEEER

SEQ ID NO: 4544 - protein, 13 aa, Artificial Sequence
  Synthetic Peptide
GSLQVVDSDRPER

SEQ ID NO: 4545 - protein, 26 aa, Artificial Sequence
  Synthetic Peptide
QEELQPMLQDCPEETGHMQHQPDRRR

SEQ ID NO: 4546 - protein, 11 aa, Artificial Sequence
  Synthetic Peptide
SSSCSGGLQHR

SEQ ID NO: 4547 - protein, 24 aa, Artificial Sequence
  Synthetic Peptide
QNEIEDLMVDVERSNAAAAALDKK

SEQ ID NO: 4548 - protein, 8 aa, Artificial Sequence
  Synthetic Peptide
VREEYPDR

SEQ ID NO: 4549 - protein, 28 aa, Artificial Sequence
  Synthetic Peptide
LDGTTFSPWQYYAVSDSECLSRYNITPR

SEQ ID NO: 4550 - protein, 28 aa, Artificial Sequence
  Synthetic Peptide
VVRSFKPDFILVRQHAYSMALGEDYRSL

SEQ ID NO: 4551 - protein, 13 aa, Artificial Sequence
  Synthetic Peptide
SRLSWPESEGKPR

SEQ ID NO: 4552 - protein, 30 aa, Artificial Sequence
  Synthetic Peptide
TMNPGYAGRQELPENLKINFRSVAMMVPDR

SEQ ID NO: 4553 - protein, 14 aa, Artificial Sequence
  Synthetic Peptide
MQLGYRLQQIAAAV

SEQ ID NO: 4554 - protein, 21 aa, Artificial Sequence
  Synthetic Peptide
SRAGGLDWPEATEVSPSRTIR

SEQ ID NO: 4555 - protein, 22 aa, Artificial Sequence
  Synthetic Peptide
QSPLSSSSPFSNRPPLPPTPSR

SEQ ID NO: 4556 - protein, 24 aa, Artificial Sequence
  Synthetic Peptide
NQMINSMAEDGSNRTVIARVPKPR

SEQ ID NO: 4557 - protein, 11 aa, Artificial Sequence
  Synthetic Peptide
HLDVVAPGREK

SEQ ID NO: 4558 - protein, 20 aa, Artificial Sequence
  Synthetic Peptide
LEAAEDIAYQLSRSRNITYL

SEQ ID NO: 4559 - protein, 24 aa, Artificial Sequence
  Synthetic Peptide
PDRGWEREQPAASTAAASLFECSR

SEQ ID NO: 4560 - protein, 16 aa, Artificial Sequence
  Synthetic Peptide
AENIMASLERSMHPEL

SEQ ID NO: 4561 - protein, 23 aa, Artificial Sequence
  Synthetic Peptide
KPRVIPGSRTAFFGYTVQQHDIS

SEQ ID NO: 4562 - protein, 7 aa, Artificial Sequence
  Synthetic Peptide
PALDEVR

SEQ ID NO: 4563 - protein, 31 aa, Artificial Sequence
  Synthetic Peptide
SNCTGAAAVQEELNPERPPGAEERVPEEDSR

SEQ ID NO: 4564 - protein, 15 aa, Artificial Sequence
  Synthetic Peptide
TEQAGRNALLSDISK

SEQ ID NO: 4565 - protein, 42 aa, Artificial Sequence
  Synthetic Peptide
KMGSYFGSSLCAVDLNGDGLSDLLVGAPMFSEIRDEGQVTVY

SEQ ID NO: 4566 - protein, 13 aa, Artificial Sequence
  Synthetic Peptide
TVINSPKMQGVER

SEQ ID NO: 4567 - protein, 12 aa, Artificial Sequence
  Synthetic Peptide
DTLYENKEIDGR

SEQ ID NO: 4568 - protein, 15 aa, Artificial Sequence
  Synthetic Peptide
DEMERSLHDALCVVK

SEQ ID NO: 4569 - protein, 15 aa, Artificial Sequence
  Synthetic Peptide
VNGTGAPGQSPGAGR

SEQ ID NO: 4570 - protein, 31 aa, Artificial Sequence
  Synthetic Peptide
FGNISGEFWLGNEALHSLTQAGDYSMRVDLR

SEQ ID NO: 4571 - protein, 16 aa, Artificial Sequence
  Synthetic Peptide
RQPTVVGEEWVDDHSR

SEQ ID NO: 4572 - protein, 18 aa, Artificial Sequence
  Synthetic Peptide
EACNPNACRASGRGLQPK

SEQ ID NO: 4573 - protein, 28 aa, Artificial Sequence
  Synthetic Peptide
GSTHMGFPENLTNGATADNGDDGLIPPR

SEQ ID NO: 4574 - protein, 21 aa, Artificial Sequence
  Synthetic Peptide
HGRCVNGMCVCDDGYTGEDCR

SEQ ID NO: 4575 - protein, 24 aa, Artificial Sequence
  Synthetic Peptide
IGQAHTVRLILKCSMMPMQVDGEP

SEQ ID NO: 4576 - protein, 23 aa, Artificial Sequence
  Synthetic Peptide
TTATMTRATNSTATPSSTLGTTR

SEQ ID NO: 4577 - protein, 25 aa, Artificial Sequence
  Synthetic Peptide
ADAQTQIQNIAASFDQEAAAILMAR

SEQ ID NO: 4578 - protein, 17 aa, Artificial Sequence
  Synthetic Peptide
PYGPCSRTCGGGVQLAR

SEQ ID NO: 4579 - protein, 13 aa, Artificial Sequence
  Synthetic Peptide
WCNNVNGVHKGCR

SEQ ID NO: 4580 - protein, 20 aa, Artificial Sequence
  Synthetic Peptide
AVGVGPGSSAGSNARAEFWR

SEQ ID NO: 4581 - protein, 18 aa, Artificial Sequence
  Synthetic Peptide
SNPWMPLGPQESPASDSR

SEQ ID NO: 4582 - protein, 21 aa, Artificial Sequence
  Synthetic Peptide
TIDFDSLSVGRGSGQVVAQQR

SEQ ID NO: 4583 - protein, 6 aa, Artificial Sequence
  Synthetic Peptide
TPLGRP

SEQ ID NO: 4584 - protein, 9 aa, Artificial Sequence
  Synthetic Peptide
FQQPADAER

SEQ ID NO: 4585 - protein, 43 aa, Artificial Sequence
  Synthetic Peptide
HARKPGYIHSGATTSTMRGDMVTEDADPYVQPEDENYENDSVR

SEQ ID NO: 4586 - protein, 15 aa, Artificial Sequence
  Synthetic Peptide
NNMEGLNVMGKLRYL

SEQ ID NO: 4587 - protein, 17 aa, Artificial Sequence
  Synthetic Peptide
SSSMSVTGGRGGPRPVS

SEQ ID NO: 4588 - protein, 25 aa, Artificial Sequence
  Synthetic Peptide
AHRPALLLLLPPLLLLLLLRVPPSR

SEQ ID NO: 4589 - protein, 14 aa, Artificial Sequence
  Synthetic Peptide
VKGTSGNRGLQGEK

SEQ ID NO: 4590 - protein, 22 aa, Artificial Sequence
  Synthetic Peptide
NRINPLQMEEEEFMEIMVEIPA

SEQ ID NO: 4591 - protein, 22 aa, Artificial Sequence
  Synthetic Peptide
RCPQCTAEITGEYVSCLLSLLR

SEQ ID NO: 4592 - protein, 20 aa, Artificial Sequence
  Synthetic Peptide
GSSEHLGQASIETMMLNLVR

SEQ ID NO: 4593 - protein, 21 aa, Artificial Sequence
  Synthetic Peptide
GGGTVGPGDRGPAAADGGRPQ

SEQ ID NO: 4594 - protein, 32 aa, Artificial Sequence
  Synthetic Peptide
YYGPGGGDVPVHPPPPLYPLRPEPPQPPISWR

SEQ ID NO: 4595 - protein, 17 aa, Artificial Sequence
  Synthetic Peptide
SSLAPVSGSGPGPSPAR

SEQ ID NO: 4596 - protein, 30 aa, Artificial Sequence
  Synthetic Peptide
RHMLFSWAERQAGQPGAVGLLVQALEQSDR

SEQ ID NO: 4597 - protein, 21 aa, Artificial Sequence
  Synthetic Peptide
EALEGFDEMRLELDQLEVREK

SEQ ID NO: 4598 - protein, 9 aa, Artificial Sequence
  Synthetic Peptide
ILDPGCPSR

SEQ ID NO: 4599 - protein, 24 aa, Artificial Sequence
  Synthetic Peptide
VLNSLVGPACIFLRPSIAATQLDR

SEQ ID NO: 4600 - protein, 13 aa, Artificial Sequence
  Synthetic Peptide
SKIGELEDESLSR

SEQ ID NO: 4601 - protein, 19 aa, Artificial Sequence
  Synthetic Peptide
RSGEQAEGSPGGPGDSQGR

SEQ ID NO: 4602 - protein, 33 aa, Artificial Sequence
  Synthetic Peptide
QRTSSVVEEHFQASVSPTEAAPPATGDQSPGLG

SEQ ID NO: 4603 - protein, 10 aa, Artificial Sequence
  Synthetic Peptide
IIDSIMALFR

SEQ ID NO: 4604 - protein, 9 aa, Artificial Sequence
  Synthetic Peptide
EVTDYAIAR

SEQ ID NO: 4605 - protein, 16 aa, Artificial Sequence
  Synthetic Peptide
QSITADDLHQLLVVAR

SEQ ID NO: 4606 - protein, 16 aa, Artificial Sequence
  Synthetic Peptide
LSSSPTASVTPTTRSR

SEQ ID NO: 4607 - protein, 33 aa, Artificial Sequence
  Synthetic Peptide
RFRAQPTLPSAHLLAMHIQQLETGGFTMTNGAH

SEQ ID NO: 4608 - protein, 12 aa, Artificial Sequence
  Synthetic Peptide
KAEDAQRVFREK

SEQ ID NO: 4609 - protein, 17 aa, Artificial Sequence
  Synthetic Peptide
SMLESMLNRILAVREIY

SEQ ID NO: 4610 - protein, 21 aa, Artificial Sequence
  Synthetic Peptide
SGIVEGAFSGWKVILHVDQSR

SEQ ID NO: 4611 - protein, 10 aa, Artificial Sequence
  Synthetic Peptide
GPGGRPPPPP

SEQ ID NO: 4612 - protein, 27 aa, Artificial Sequence
  Synthetic Peptide
AGQEEVGMPPLPPPQQPPPPSPPQPSR

SEQ ID NO: 4613 - protein, 29 aa, Artificial Sequence
  Synthetic Peptide
ALRTHGGAPGDREGPAPLFLAPQVCGPAR

SEQ ID NO: 4614 - protein, 13 aa, Artificial Sequence
  Synthetic Peptide
AFSQSSSLTVHVR

SEQ ID NO: 4615 - protein, 24 aa, Artificial Sequence
  Synthetic Peptide
AQETNHSQVPMLCSTGCGFYGNPR

SEQ ID NO: 4616 - protein, 21 aa, Artificial Sequence
  Synthetic Peptide
RLEAGAMVLADRGVVCIDEFD

SEQ ID NO: 4617 - protein, 8 aa, Artificial Sequence
  Synthetic Peptide
EMYERENR

SEQ ID NO: 4618 - protein, 25 aa, Artificial Sequence
  Synthetic Peptide
GGAGGAPASSSSSSVAAAAASGQCR

SEQ ID NO: 4619 - protein, 33 aa, Artificial Sequence
  Synthetic Peptide
DRIYQDERERSMNPNVSMVSSASSSPSSSRTPQ

SEQ ID NO: 4620 - protein, 32 aa, Artificial Sequence
  Synthetic Peptide
DTLLNHMLIHGLSCPYCRSTFNDVEKMAAHMR

SEQ ID NO: 4621 - protein, 30 aa, Artificial Sequence
  Synthetic Peptide
TLTRPAGTTAMRSGLPRPSAPSAGGIPVPR

SEQ ID NO: 4622 - protein, 15 aa, Artificial Sequence
  Synthetic Peptide
QMIRNYQHQLLQQNR

SEQ ID NO: 4623 - protein, 13 aa, Artificial Sequence
  Synthetic Peptide
EEWYSPGIYELRR

SEQ ID NO: 4624 - protein, 20 aa, Artificial Sequence
  Synthetic Peptide
GYNLLPSITDVTMENNLSRV

SEQ ID NO: 4625 - protein, 28 aa, Artificial Sequence
  Synthetic Peptide
CSSKTCSKPSENEVPQQAIDSHSVKNFR

SEQ ID NO: 4626 - protein, 19 aa, Artificial Sequence
  Synthetic Peptide
TVASTAMNSQSSRSHAIFT

SEQ ID NO: 4627 - protein, 24 aa, Artificial Sequence
  Synthetic Peptide
QVLPDPEVLEAVGDRQDGLREQLQ

SEQ ID NO: 4628 - protein, 32 aa, Artificial Sequence
  Synthetic Peptide
IGTSTSFDSGIAGLSSISQCTSSSQLDETSHR

SEQ ID NO: 4629 - protein, 23 aa, Artificial Sequence
  Synthetic Peptide
YFSETLRSEMEMFNDHSPQHGLG

SEQ ID NO: 4630 - protein, 18 aa, Artificial Sequence
  Synthetic Peptide
TRPRQARPAAPMEGAVQL

SEQ ID NO: 4631 - protein, 15 aa, Artificial Sequence
  Synthetic Peptide
IGLGGRGGSGGSYGR

SEQ ID NO: 4632 - protein, 26 aa, Artificial Sequence
  Synthetic Peptide
DRSLVLGHQSQSSPPHGEADGHPSEK

SEQ ID NO: 4633 - protein, 26 aa, Artificial Sequence
  Synthetic Peptide
GSRGGSGGSYGGGGSGGGYGGGSGSR

SEQ ID NO: 4634 - protein, 27 aa, Artificial Sequence
  Synthetic Peptide
STSGGGGGGGGGGGGGKSGGIVISPFR

SEQ ID NO: 4635 - protein, 28 aa, Artificial Sequence
  Synthetic Peptide
GGSGGGGGGSSGGRGSGGGSSGGSIGGR

SEQ ID NO: 4636 - protein, 22 aa, Artificial Sequence
  Synthetic Peptide
GSGGGSSGGSIGGRGSSSGGVK

SEQ ID NO: 4637 - protein, 18 aa, Artificial Sequence
  Synthetic Peptide
DPELQQLLACGLGTSVAR

SEQ ID NO: 4638 - protein, 15 aa, Artificial Sequence
  Synthetic Peptide
EPEKMPQVTVDVLQR

SEQ ID NO: 4639 - protein, 27 aa, Artificial Sequence
  Synthetic Peptide
MFNFLENDVEQVSQLAVFIEAALDYHR

SEQ ID NO: 4640 - protein, 26 aa, Artificial Sequence
  Synthetic Peptide
GQGQDSASPIRTTHTGQVLGSLVHVK

SEQ ID NO: 4641 - protein, 13 aa, Artificial Sequence
  Synthetic Peptide
NDRLYAIGGNHLK

SEQ ID NO: 4642 - protein, 18 aa, Artificial Sequence
  Synthetic Peptide
RPSVGSQSNQAGQGKRPK

SEQ ID NO: 4643 - protein, 9 aa, Artificial Sequence
  Synthetic Peptide
ERGRVLCHR

SEQ ID NO: 4644 - protein, 35 aa, Artificial Sequence
  Synthetic Peptide
PFEDSDSERPMPRLEPTFEIDEEEEEEDENELFPR

SEQ ID NO: 4645 - protein, 24 aa, Artificial Sequence
  Synthetic Peptide
MQPGSAPPPGRMDPSAPQPRAETS

SEQ ID NO: 4646 - protein, 14 aa, Artificial Sequence
  Synthetic Peptide
SLALRVADEMDLTL

SEQ ID NO: 4647 - protein, 14 aa, Artificial Sequence
  Synthetic Peptide
MGAFQEFPQVEACR

SEQ ID NO: 4648 - protein, 24 aa, Artificial Sequence
  Synthetic Peptide
QENQEAEREGGMSCSCSSGSGEAS

SEQ ID NO: 4649 - protein, 14 aa, Artificial Sequence
  Synthetic Peptide
RPDSPTRPTLRGSE

SEQ ID NO: 4650 - protein, 12 aa, Artificial Sequence
  Synthetic Peptide
PMFRGIYRGVQK

SEQ ID NO: 4651 - protein, 14 aa, Artificial Sequence
  Synthetic Peptide
RMNSLEMTPAVRQR

SEQ ID NO: 4652 - protein, 18 aa, Artificial Sequence
  Synthetic Peptide
FAYNDQGQVRLRAGLPIY

SEQ ID NO: 4653 - protein, 25 aa, Artificial Sequence
  Synthetic Peptide
LDSHRAFVVKYAPGQDLELGCHYDN

SEQ ID NO: 4654 - protein, 14 aa, Artificial Sequence
  Synthetic Peptide
VVWTVFREPIQLHR

SEQ ID NO: 4655 - protein, 17 aa, Artificial Sequence
  Synthetic Peptide
RLGEPEDCAGIVSFLCS

SEQ ID NO: 4656 - protein, 17 aa, Artificial Sequence
  Synthetic Peptide
VPDDPEHLAARRQWRDE

SEQ ID NO: 4657 - protein, 17 aa, Artificial Sequence
  Synthetic Peptide
PVVDAITDALLAARPRR

SEQ ID NO: 4658 - protein, 31 aa, Artificial Sequence
  Synthetic Peptide
QEFACRGQFVPVGGTWVEMDGNLPSGEAMVR

SEQ ID NO: 4659 - protein, 13 aa, Artificial Sequence
  Synthetic Peptide
SILLRGFDQEMAE

SEQ ID NO: 4660 - protein, 11 aa, Artificial Sequence
  Synthetic Peptide
PVQGAMYSFPR

SEQ ID NO: 4661 - protein, 12 aa, Artificial Sequence
  Synthetic Peptide
MQVLFSGEATHR

SEQ ID NO: 4662 - protein, 20 aa, Artificial Sequence
  Synthetic Peptide
SMDAIRSLASVSYAAVDFFR

SEQ ID NO: 4663 - protein, 23 aa, Artificial Sequence
  Synthetic Peptide
WGPFDLVIGGSPCNDLSNVNPAR

SEQ ID NO: 4664 - protein, 37 aa, Artificial Sequence
  Synthetic Peptide
YGNVLVLDGVIQCTERDEFSYQEMIANLPLCSHPNPR

SEQ ID NO: 4665 - protein, 31 aa, Artificial Sequence
  Synthetic Peptide
ALLVAAEFWEQGDLERTVLQQNPIPMMDRNK

SEQ ID NO: 4666 - protein, 23 aa, Artificial Sequence
  Synthetic Peptide
EMSREAGNNSRGPRPGPEGCSAG

SEQ ID NO: 4667 - protein, 27 aa, Artificial Sequence
  Synthetic Peptide
YGVIFVVDSSDEERMEETKEAMSEMLR

SEQ ID NO: 4668 - protein, 27 aa, Artificial Sequence
  Synthetic Peptide
SNQQHGDKMMSFDTRAPMAAQGMVETR

SEQ ID NO: 4669 - protein, 32 aa, Artificial Sequence
  Synthetic Peptide
VAPDFLGSTSSVSVGPAWMMVPAGRSMLVVAR

SEQ ID NO: 4670 - protein, 13 aa, Artificial Sequence
  Synthetic Peptide
WTRHPDLPPAHFR

SEQ ID NO: 4671 - protein, 21 aa, Artificial Sequence
  Synthetic Peptide
YRTITTAYYRGAMGFLLMYDI

SEQ ID NO: 4672 - protein, 12 aa, Artificial Sequence
  Synthetic Peptide
DDRYASRSHQAR

SEQ ID NO: 4673 - protein, 23 aa, Artificial Sequence
  Synthetic Peptide
NSMNEAEAAGPLAGLQASMPRER

SEQ ID NO: 4674 - protein, 22 aa, Artificial Sequence
  Synthetic Peptide
RSLDDLESATVSDGELTGADLK

SEQ ID NO: 4675 - protein, 12 aa, Artificial Sequence
  Synthetic Peptide
GHRGSEHLNSYE

SEQ ID NO: 4676 - protein, 24 aa, Artificial Sequence
  Synthetic Peptide
RACWSLGNAYVSMGRPAQALTFAK

SEQ ID NO: 4677 - protein, 22 aa, Artificial Sequence
  Synthetic Peptide
RRVFIVETMGGYCGYLATVTGI

SEQ ID NO: 4678 - protein, 17 aa, Artificial Sequence
  Synthetic Peptide
SGSKEGFYMYIETSRPR

SEQ ID NO: 4679 - protein, 46 aa, Artificial Sequence
  Synthetic Peptide
VQGYALQLHQLQVLYKAKYGPMWMSYLGPQMHVNLASAPLLEQVMR

SEQ ID NO: 4680 - protein, 14 aa, Artificial Sequence
  Synthetic Peptide
VNDNIFASSSDDGR

SEQ ID NO: 4681 - protein, 12 aa, Artificial Sequence
  Synthetic Peptide
RVYMPCLYVYNK

SEQ ID NO: 4682 - protein, 20 aa, Artificial Sequence
  Synthetic Peptide
EKPAYYALEGSVAIAGAVIR

SEQ ID NO: 4683 - protein, 19 aa, Artificial Sequence
  Synthetic Peptide
EGALSMARATLAQRSYLPQ

SEQ ID NO: 4684 - protein, 23 aa, Artificial Sequence
  Synthetic Peptide
ARVQQIQVPLGDAARPSHLLTSQ

SEQ ID NO: 4685 - protein, 37 aa, Artificial Sequence
  Synthetic Peptide
SPPSEMSPPVSSMTVSMPSMAVSPFMEEERPLLLVTP

SEQ ID NO: 4686 - protein, 29 aa, Artificial Sequence
  Synthetic Peptide
ATEEDTIRMMITQGNMQLKELEKTLALAK

SEQ ID NO: 4687 - protein, 12 aa, Artificial Sequence
  Synthetic Peptide
ELNSLGRPDILV

SEQ ID NO: 4688 - protein, 25 aa, Artificial Sequence
  Synthetic Peptide
PTPEISWLKNDQPVTFLDRYRMEVR

SEQ ID NO: 4689 - protein, 14 aa, Artificial Sequence
  Synthetic Peptide
SPEVPIEAGQYRSK

SEQ ID NO: 4690 - protein, 35 aa, Artificial Sequence
  Synthetic Peptide
LLQDDRRVTPTCHSSTSEPRCSRFDPDGSGSPATW

SEQ ID NO: 4691 - protein, 14 aa, Artificial Sequence
  Synthetic Peptide
LPPCTPTPPCAEMR

SEQ ID NO: 4692 - protein, 21 aa, Artificial Sequence
  Synthetic Peptide
KNQLLSCSADGTVRLWNPQEK

SEQ ID NO: 4693 - protein, 10 aa, Artificial Sequence
  Synthetic Peptide
SVPSILRSNR

SEQ ID NO: 4694 - protein, 7 aa, Artificial Sequence
  Synthetic Peptide
IVTSGSR

SEQ ID NO: 4695 - protein, 21 aa, Artificial Sequence
  Synthetic Peptide
NSHRTTMGCQWRLVAPLNHII

SEQ ID NO: 4696 - protein, 33 aa, Artificial Sequence
  Synthetic Peptide
GPQSGGLPPPPRAVPSSSSPQAQALTEDGRPCR

SEQ ID NO: 4697 - protein, 12 aa, Artificial Sequence
  Synthetic Peptide
LAQEQFFLMCTR

SEQ ID NO: 4698 - protein, 19 aa, Artificial Sequence
  Synthetic Peptide
FDPRTFHNDLALVQLWTPV

SEQ ID NO: 4699 - protein, 13 aa, Artificial Sequence
  Synthetic Peptide
FIGIGGNYDGTGR

SEQ ID NO: 4700 - protein, 35 aa, Artificial Sequence
  Synthetic Peptide
RCSDTEGTVVAPPTVIQVPSLGPPSEQDCMFGNGK

SEQ ID NO: 4701 - protein, 22 aa, Artificial Sequence
  Synthetic Peptide
NLLPKRGPQAFDAFCEALRETK

SEQ ID NO: 4702 - protein, 18 aa, Artificial Sequence
  Synthetic Peptide
LAAMYGGRPSSSRGGKPR

SEQ ID NO: 4703 - protein, 9 aa, Artificial Sequence
  Synthetic Peptide
VLSLSPSYR

SEQ ID NO: 4704 - protein, 22 aa, Artificial Sequence
  Synthetic Peptide
PMQSREFPPGTPRFNNYVDCMK

SEQ ID NO: 4705 - protein, 20 aa, Artificial Sequence
  Synthetic Peptide
SRSISGASSGLSTSPLSSPR

SEQ ID NO: 4706 - protein, 13 aa, Artificial Sequence
  Synthetic Peptide
MFLDSNFTDTESR

SEQ ID NO: 4707 - protein, 42 aa, Artificial Sequence
  Synthetic Peptide
NLRLLGSSDSPASASRVAGITGVCHHAQDQVAGECIIEKQGR

SEQ ID NO: 4708 - protein, 31 aa, Artificial Sequence
  Synthetic Peptide
ELLFNEVVIMRDYHHDNVVDMYSSYLVGDEL

SEQ ID NO: 4709 - protein, 29 aa, Artificial Sequence
  Synthetic Peptide
AGIVAELQAPDLRNFRAVFMAVVMGQGQR

SEQ ID NO: 4710 - protein, 13 aa, Artificial Sequence
  Synthetic Peptide
RSGLNATFMAFNR

SEQ ID NO: 4711 - protein, 26 aa, Artificial Sequence
  Synthetic Peptide
SPCSPQPPPAAPGAGGGSGSAPGPSR

SEQ ID NO: 4712 - protein, 20 aa, Artificial Sequence
  Synthetic Peptide
LQAEGNATGAFLIRVSEKPS

SEQ ID NO: 4713 - protein, 32 aa, Artificial Sequence
  Synthetic Peptide
LVLLHGVCMAGDSTMVQEFVHLGAIDMYLRKR

SEQ ID NO: 4714 - protein, 29 aa, Artificial Sequence
  Synthetic Peptide
AAFAMALDPAAPAPAAPTPTPAPFSRFTV

SEQ ID NO: 4715 - protein, 37 aa, Artificial Sequence
  Synthetic Peptide
LTRTSVTVSDLEPHMNYTFTVEARNGVSGLVTSRSFR

SEQ ID NO: 4716 - protein, 31 aa, Artificial Sequence
  Synthetic Peptide
YVEMRPVSTSSNDSFSEQDLDKEDGRPLELR

SEQ ID NO: 4717 - protein, 27 aa, Artificial Sequence
  Synthetic Peptide
QEPPPNPAPAAPAPGEDDPSSWASPRR

SEQ ID NO: 4718 - protein, 23 aa, Artificial Sequence
  Synthetic Peptide
YMEFLEVLTEGLNRVLLVRGGGR

SEQ ID NO: 4719 - protein, 16 aa, Artificial Sequence
  Synthetic Peptide
QVPQGHLQSMPTGNMR

SEQ ID NO: 4720 - protein, 15 aa, Artificial Sequence
  Synthetic Peptide
GQDVLQDLQRTLAIR

SEQ ID NO: 4721 - protein, 32 aa, Artificial Sequence
  Synthetic Peptide
FCLGLVGRASAPAEPDSACCMELPAAAGDAVR

SEQ ID NO: 4722 - protein, 16 aa, Artificial Sequence
  Synthetic Peptide
NQRPTHLAGAFLAFIL

SEQ ID NO: 4723 - protein, 20 aa, Artificial Sequence
  Synthetic Peptide
SSTFDTDTFCPPRPKPVARK

SEQ ID NO: 4724 - protein, 14 aa, Artificial Sequence
  Synthetic Peptide
FYGPEGPYGVFAGR

SEQ ID NO: 4725 - protein, 46 aa, Artificial Sequence
  Synthetic Peptide
PTWTLTLVYFFSLVHGLTLVGTSSNPCGVMMQMMLGGMSPETGAVR

SEQ ID NO: 4726 - protein, 21 aa, Artificial Sequence
  Synthetic Peptide
ESIDPAGEETMSPTSPTLMPR

SEQ ID NO: 4727 - protein, 34 aa, Artificial Sequence
  Synthetic Peptide
NRRVCLFMVVGSWVGGSLDGFMLTPVTMSFPFCR

SEQ ID NO: 4728 - protein, 24 aa, Artificial Sequence
  Synthetic Peptide
CIGIGGCTLSSWLTCRLASYEQRR

SEQ ID NO: 4729 - protein, 10 aa, Artificial Sequence
  Synthetic Peptide
RNMESIGLGM

SEQ ID NO: 4730 - protein, 17 aa, Artificial Sequence
  Synthetic Peptide
INLFGSIFFLTCMSVDR

SEQ ID NO: 4731 - protein, 15 aa, Artificial Sequence
  Synthetic Peptide
HFYKSRSCSDLENGK

SEQ ID NO: 4732 - protein, 32 aa, Artificial Sequence
  Synthetic Peptide
QRILHTLLASGEDALDFTQESEPSYISDVGPP

SEQ ID NO: 4733 - protein, 8 aa, Artificial Sequence
  Synthetic Peptide
RPPGRPDE

SEQ ID NO: 4734 - protein, 9 aa, Artificial Sequence
  Synthetic Peptide
SVRQELGIA

SEQ ID NO: 4735 - protein, 48 aa, Artificial Sequence
  Synthetic Peptide
MPPEPFWEAHDTLELQLSSPPARDVAATLAVAVSFEAACPQRPSHLWK

SEQ ID NO: 4736 - protein, 15 aa, Artificial Sequence
  Synthetic Peptide
LEQGSPQNGAPRPMR

SEQ ID NO: 4737 - protein, 9 aa, Artificial Sequence
  Synthetic Peptide
ERCGVPFSC

SEQ ID NO: 4738 - protein, 19 aa, Artificial Sequence
  Synthetic Peptide
FHCTDLGVTILVNRGFVPR

SEQ ID NO: 4739 - protein, 24 aa, Artificial Sequence
  Synthetic Peptide
EQGAEEGPGVPAATTEDHIQVEAR

SEQ ID NO: 4740 - protein, 15 aa, Artificial Sequence
  Synthetic Peptide
LLAIDYTGCGINPAR

SEQ ID NO: 4741 - protein, 9 aa, Artificial Sequence
  Synthetic Peptide
LTSGENLAR

SEQ ID NO: 4742 - protein, 29 aa, Artificial Sequence
  Synthetic Peptide
YLGHTIKSGDLEYVGMEGGIVLSVESMKR

SEQ ID NO: 4743 - protein, 9 aa, Artificial Sequence
  Synthetic Peptide
PPLPELRLR

SEQ ID NO: 4744 - protein, 28 aa, Artificial Sequence
  Synthetic Peptide
DINIYDLFVWMHYYVSMDALLGGSEIWR

SEQ ID NO: 4745 - protein, 22 aa, Artificial Sequence
  Synthetic Peptide
AVATGAASDPAPPGRPQEMGPK

SEQ ID NO: 4746 - protein, 22 aa, Artificial Sequence
  Synthetic Peptide
ATSDNLQVRGSDYSHSEDLADF

SEQ ID NO: 4747 - protein, 25 aa, Artificial Sequence
  Synthetic Peptide
DREEQELYELVVEASRELDHLRVAR

SEQ ID NO: 4748 - protein, 36 aa, Artificial Sequence
  Synthetic Peptide
GHGEDILASVEQITIVSRPLSGQRGAGPGNSAYTPR

SEQ ID NO: 4749 - protein, 9 aa, Artificial Sequence
  Synthetic Peptide
LDELRDEGK

SEQ ID NO: 4750 - protein, 25 aa, Artificial Sequence
  Synthetic Peptide
HTTTYRLPNRVDGTGFVVYDGAVFY

SEQ ID NO: 4751 - protein, 23 aa, Artificial Sequence
  Synthetic Peptide
ACHVQCTNNTQLRVDYVIFDNFR

SEQ ID NO: 4752 - protein, 31 aa, Artificial Sequence
  Synthetic Peptide
APDSPSSVGRPSSDPGLSPTQPCPEGSGDCR

SEQ ID NO: 4753 - protein, 9 aa, Artificial Sequence
  Synthetic Peptide
IVMTYSTER

SEQ ID NO: 4754 - protein, 33 aa, Artificial Sequence
  Synthetic Peptide
MTADDDIFIHMPNLIEYLQSLEQIGVQDFWIGR

SEQ ID NO: 4755 - protein, 13 aa, Artificial Sequence
  Synthetic Peptide
CQGLNFSGADLSR

SEQ ID NO: 4756 - protein, 17 aa, Artificial Sequence
  Synthetic Peptide
TPRPGVESADSRRLATK

SEQ ID NO: 4757 - protein, 20 aa, Artificial Sequence
  Synthetic Peptide
QQHVVATGGQDGMLSIWDVR

SEQ ID NO: 4758 - protein, 12 aa, Artificial Sequence
  Synthetic Peptide
VTRDASVLKAFQ

SEQ ID NO: 4759 - protein, 16 aa, Artificial Sequence
  Synthetic Peptide
TQVIQESCERRNNIGR

SEQ ID NO: 4760 - protein, 22 aa, Artificial Sequence
  Synthetic Peptide
VHTECCHGDLLECADDRADLAK

SEQ ID NO: 4761 - protein, 22 aa, Artificial Sequence
  Synthetic Peptide
MVSLFHTVIFPLMNPMIYTLRN

SEQ ID NO: 4762 - protein, 30 aa, Artificial Sequence
  Synthetic Peptide
LLSGALALTQTWAGSHSMRYFYTSVSRPGR

SEQ ID NO: 4763 - protein, 33 aa, Artificial Sequence
  Synthetic Peptide
EYSVSLPSDPDRGVGRTHEISVRNSGSCLCLPR

SEQ ID NO: 4764 - protein, 15 aa, Artificial Sequence
  Synthetic Peptide
HSMRYFYTAVSRPGR

SEQ ID NO: 4765 - protein, 7 aa, Artificial Sequence
  Synthetic Peptide
YWNSLFR

SEQ ID NO: 4766 - protein, 25 aa, Artificial Sequence
  Synthetic Peptide
GSGTTAHVGIMLYGVDSRSGHRHLD

SEQ ID NO: 4767 - protein, 21 aa, Artificial Sequence
  Synthetic Peptide
IPATECEFVGSLPVIVVGRLK

SEQ ID NO: 4768 - protein, 17 aa, Artificial Sequence
  Synthetic Peptide
SDPRVAGLETISTATGR

SEQ ID NO: 4769 - protein, 29 aa, Artificial Sequence
  Synthetic Peptide
YKYNSYRDCMLLGCLNSGTSFVSGFAIFS

SEQ ID NO: 4770 - protein, 18 aa, Artificial Sequence
  Synthetic Peptide
IIVPSLLLLLCLALWYMR

SEQ ID NO: 4771 - protein, 20 aa, Artificial Sequence
  Synthetic Peptide
EESDFQTTGQFGFPEGRSGR

SEQ ID NO: 4772 - protein, 25 aa, Artificial Sequence
  Synthetic Peptide
SRRIMSTTNVRKLMNCGGFGMEATL

SEQ ID NO: 4773 - protein, 31 aa, Artificial Sequence
  Synthetic Peptide
AEGSFAPMGSLQPDAGNASWNGTEAPGGGAR

SEQ ID NO: 4774 - protein, 20 aa, Artificial Sequence
  Synthetic Peptide
TFQDSNNSVDSSASDSDPMR

SEQ ID NO: 4775 - protein, 18 aa, Artificial Sequence
  Synthetic Peptide
AGAQAAGSTWLQGFGRPS

SEQ ID NO: 4776 - protein, 33 aa, Artificial Sequence
  Synthetic Peptide
YFTSDAGIAGKVERNIPEVYVADGHWHTFLIGK

SEQ ID NO: 4777 - protein, 18 aa, Artificial Sequence
  Synthetic Peptide
SLAEDHDPYDPWSLERPR

SEQ ID NO: 4778 - protein, 15 aa, Artificial Sequence
  Synthetic Peptide
YHRSSLYCSDIPSIH

SEQ ID NO: 4779 - protein, 16 aa, Artificial Sequence
  Synthetic Peptide
CRMDMMSLNSQLLDAI

SEQ ID NO: 4780 - protein, 9 aa, Artificial Sequence
  Synthetic Peptide
TPVSDRVTK

SEQ ID NO: 4781 - protein, 22 aa, Artificial Sequence
  Synthetic Peptide
DPYGMPGGCSHICLLSSSYKTR

SEQ ID NO: 4782 - protein, 23 aa, Artificial Sequence
  Synthetic Peptide
AFGGAGATALVFLYFCIIFVVVR

SEQ ID NO: 4783 - protein, 28 aa, Artificial Sequence
  Synthetic Peptide
NLVCFDKTGTLTEDGLDLWGIQRVENAR

SEQ ID NO: 4784 - protein, 28 aa, Artificial Sequence
  Synthetic Peptide
GLPSPSDTTSVYHSPGRNVLGTESRDGP

SEQ ID NO: 4785 - protein, 22 aa, Artificial Sequence
  Synthetic Peptide
ANPILAMVGENTTLRCHLSPEK

SEQ ID NO: 4786 - protein, 12 aa, Artificial Sequence
  Synthetic Peptide
GGGGGSGGGGRR

SEQ ID NO: 4787 - protein, 25 aa, Artificial Sequence
  Synthetic Peptide
LQGLLDPESAHRLAVRFTSLGLLPR

SEQ ID NO: 4788 - protein, 28 aa, Artificial Sequence
  Synthetic Peptide
MAMYFWEMGSNAVSSALGACLLLRVMAR

SEQ ID NO: 4789 - protein, 22 aa, Artificial Sequence
  Synthetic Peptide
SDLNNMEDDDPQTSYMVSAWAR

SEQ ID NO: 4790 - protein, 15 aa, Artificial Sequence
  Synthetic Peptide
DCSAVQALEAAAPCR

SEQ ID NO: 4791 - protein, 15 aa, Artificial Sequence
  Synthetic Peptide
LGETYELVRDDLGFR

SEQ ID NO: 4792 - protein, 18 aa, Artificial Sequence
  Synthetic Peptide
SHDALPERTVIQLDSSPR

SEQ ID NO: 4793 - protein, 24 aa, Artificial Sequence
  Synthetic Peptide
AEAAAESGTSAADERGPGTRGARR

SEQ ID NO: 4794 - protein, 24 aa, Artificial Sequence
  Synthetic Peptide
AEAAAESGTSAADERGPGTRGARR

SEQ ID NO: 4795 - protein, 42 aa, Artificial Sequence
  Synthetic Peptide
RLSPQGLILQGQEQQVSEEGSGKAMLEEALPVSLSQGQPSRQ

SEQ ID NO: 4796 - protein, 16 aa, Artificial Sequence
  Synthetic Peptide
METNREELYDLLETLR

SEQ ID NO: 4797 - protein, 16 aa, Artificial Sequence
  Synthetic Peptide
EAAAVFKTLPGPKIAR

SEQ ID NO: 4798 - protein, 17 aa, Artificial Sequence
  Synthetic Peptide
EMVFEGGPRPWILEPSR

SEQ ID NO: 4799 - protein, 15 aa, Artificial Sequence
  Synthetic Peptide
LWTAPELLRDPALER

SEQ ID NO: 4800 - protein, 22 aa, Artificial Sequence
  Synthetic Peptide
DGGGGGGGSGGGGRPTLSSPEK

SEQ ID NO: 4801 - protein, 40 aa, Artificial Sequence
  Synthetic Peptide
FFALVNALDEHLFPVRIGDMRIMENNLENELKSSISALNS

SEQ ID NO: 4802 - protein, 19 aa, Artificial Sequence
  Synthetic Peptide
NEEMDLEEPEGYMPDLDSR

SEQ ID NO: 4803 - protein, 21 aa, Artificial Sequence
  Synthetic Peptide
ADMILLDDNFASIVTGVEQGR

SEQ ID NO: 4804 - protein, 34 aa, Artificial Sequence
  Synthetic Peptide
VCALSEADLIEFPCDRFMDSAGGGAGGSLRREDR

SEQ ID NO: 4805 - protein, 18 aa, Artificial Sequence
  Synthetic Peptide
SDSGVMLPTLRVSLIQDM

SEQ ID NO: 4806 - protein, 18 aa, Artificial Sequence
  Synthetic Peptide
LIGFEVGPPEAGERPDRR

SEQ ID NO: 4807 - protein, 37 aa, Artificial Sequence
  Synthetic Peptide
SDMDRGDGSIKYILSGEGAGIVFTIDDTTGDIHAIQR

SEQ ID NO: 4808 - protein, 35 aa, Artificial Sequence
  Synthetic Peptide
ATIEDSMTQVMSSSRGPSPDQSTMSQDISTEVITR

SEQ ID NO: 4809 - protein, 13 aa, Artificial Sequence
  Synthetic Peptide
GNSDRPLNDNQWH

SEQ ID NO: 4810 - protein, 13 aa, Artificial Sequence
  Synthetic Peptide
GVADSCTSLLSGR

SEQ ID NO: 4811 - protein, 26 aa, Artificial Sequence
  Synthetic Peptide
LTPGLRETRTSQDITSSTETSTVLYK

SEQ ID NO: 4812 - protein, 19 aa, Artificial Sequence
  Synthetic Peptide
SLTPSPESPPLPDVSAFSR

SEQ ID NO: 4813 - protein, 18 aa, Artificial Sequence
  Synthetic Peptide
LRALGEPITLFGEGPAER

SEQ ID NO: 4814 - protein, 10 aa, Artificial Sequence
  Synthetic Peptide
GGGRPLLPSG

SEQ ID NO: 4815 - protein, 13 aa, Artificial Sequence
  Synthetic Peptide
CPLNGGQQSLYRR

SEQ ID NO: 4816 - protein, 12 aa, Artificial Sequence
  Synthetic Peptide
FESRSGGYGGSR

SEQ ID NO: 4817 - protein, 16 aa, Artificial Sequence
  Synthetic Peptide
VPTGPTINTTIQDVNR

SEQ ID NO: 4818 - protein, 17 aa, Artificial Sequence
  Synthetic Peptide
TKNLRLLILVGRLFMWE

SEQ ID NO: 4819 - protein, 12 aa, Artificial Sequence
  Synthetic Peptide
ALSRQEMQEVQS

SEQ ID NO: 4820 - protein, 37 aa, Artificial Sequence
  Synthetic Peptide
ALSRQEMQEVQSSRSGRGGNFGFGDSRGGGGNFGPGP

SEQ ID NO: 4821 - protein, 10 aa, Artificial Sequence
  Synthetic Peptide
GRGGGGGGFR

SEQ ID NO: 4822 - protein, 17 aa, Artificial Sequence
  Synthetic Peptide
QQTQPPAKQSNNPPLQR

SEQ ID NO: 4823 - protein, 28 aa, Artificial Sequence
  Synthetic Peptide
TPPVALNSSRMSCFSRPSMSPTPLDRCR

SEQ ID NO: 4824 - protein, 27 aa, Artificial Sequence
  Synthetic Peptide
TAVAPSAVNLADPRTPTAPAVNLAGAR

SEQ ID NO: 4825 - protein, 22 aa, Artificial Sequence
  Synthetic Peptide
MAPALSGANLTSPRVPLSAYER

SEQ ID NO: 4826 - protein, 34 aa, Artificial Sequence
  Synthetic Peptide
SVTGLSLSSEGSYLLSNAMDNTVRVWDVRPFAPK

SEQ ID NO: 4827 - protein, 17 aa, Artificial Sequence
  Synthetic Peptide
RGGGGGGGGGNFRGGGR

SEQ ID NO: 4828 - protein, 16 aa, Artificial Sequence
  Synthetic Peptide
LFIGGLSFETTDESLR

SEQ ID NO: 4829 - protein, 13 aa, Artificial Sequence
  Synthetic Peptide
DQGGFGDRNEYGS

SEQ ID NO: 4830 - protein, 9 aa, Artificial Sequence
  Synthetic Peptide
RGRPGDRYD

SEQ ID NO: 4831 - protein, 10 aa, Artificial Sequence
  Synthetic Peptide
GGPLPEPRPL

SEQ ID NO: 4832 - protein, 13 aa, Artificial Sequence
  Synthetic Peptide
GLDARGLEARAME

SEQ ID NO: 4833 - protein, 16 aa, Artificial Sequence
  Synthetic Peptide
LFIGGLSFETTDDSLR

SEQ ID NO: 4834 - protein, 20 aa, Artificial Sequence
  Synthetic Peptide
FIYTREGRPSGEAFVELESE

SEQ ID NO: 4835 - protein, 14 aa, Artificial Sequence
  Synthetic Peptide
LLGMGPEGQPLGRR

SEQ ID NO: 4836 - protein, 32 aa, Artificial Sequence
  Synthetic Peptide
GMPTGEAMVAFESRDEATAAVIDLNDRPIGSR

SEQ ID NO: 4837 - protein, 16 aa, Artificial Sequence
  Synthetic Peptide
SSAGTSAHYEMLGTCR

SEQ ID NO: 4838 - protein, 18 aa, Artificial Sequence
  Synthetic Peptide
ECLQTCRTVAACNLPIVR

SEQ ID NO: 4839 - protein, 25 aa, Artificial Sequence
  Synthetic Peptide
SAGSRFSSWESLEPGEVVTGPCDNC

SEQ ID NO: 4840 - protein, 20 aa, Artificial Sequence
  Synthetic Peptide
DKGMTNINDGLLRGISMLNK

SEQ ID NO: 4841 - protein, 30 aa, Artificial Sequence
  Synthetic Peptide
LSDQPENTFLHPIIQIDRSFMLLILERSTR

SEQ ID NO: 4842 - protein, 14 aa, Artificial Sequence
  Synthetic Peptide
RGGVYEHLGGAPRR

SEQ ID NO: 4843 - protein, 15 aa, Artificial Sequence
  Synthetic Peptide
DFNFLEVMSMENNGR

SEQ ID NO: 4844 - protein, 10 aa, Artificial Sequence
  Synthetic Peptide
PGAPGDQGQR

SEQ ID NO: 4845 - protein, 18 aa, Artificial Sequence
  Synthetic Peptide
TATVLVQQGTCEVIAAHR

SEQ ID NO: 4846 - protein, 18 aa, Artificial Sequence
  Synthetic Peptide
DHLSMSTRAIRPTEEGGL

SEQ ID NO: 4847 - protein, 18 aa, Artificial Sequence
  Synthetic Peptide
YQMQRRPYVSYVNNSIAR

SEQ ID NO: 4848 - protein, 24 aa, Artificial Sequence
  Synthetic Peptide
EGPSLQLEDVNIEELYKGGEEATR

SEQ ID NO: 4849 - protein, 23 aa, Artificial Sequence
  Synthetic Peptide
EIMAMNGNRPIPHIDPSRPMTPQ

SEQ ID NO: 4850 - protein, 41 aa, Artificial Sequence
  Synthetic Peptide
GGMIPEGGGGNQEPRQQPQPPPEEPAQAAMEGPQPENMQPR

SEQ ID NO: 4851 - protein, 19 aa, Artificial Sequence
  Synthetic Peptide
IITDFLMPLTREQFQDVLA

SEQ ID NO: 4852 - protein, 23 aa, Artificial Sequence
  Synthetic Peptide
LEDSLHQPLQGSPTRPASAFDRP

SEQ ID NO: 4853 - protein, 21 aa, Artificial Sequence
  Synthetic Peptide
MSHNPIMGHGSQEPPMVPQGR

SEQ ID NO: 4854 - protein, 36 aa, Artificial Sequence
  Synthetic Peptide
WLRPEVHTKEQMLTMLPKEIQAWLQEHRPESSEEAA

SEQ ID NO: 4855 - protein, 14 aa, Artificial Sequence
  Synthetic Peptide
IGSTRYGDGPRPPK

SEQ ID NO: 4856 - protein, 13 aa, Artificial Sequence
  Synthetic Peptide
GEGAINLALAQNR

SEQ ID NO: 4857 - protein, 27 aa, Artificial Sequence
  Synthetic Peptide
CIQIRSEENMPGGGLSAGLASANSNVR

SEQ ID NO: 4858 - protein, 9 aa, Artificial Sequence
  Synthetic Peptide
PLPRPMENR

SEQ ID NO: 4859 - protein, 19 aa, Artificial Sequence
  Synthetic Peptide
GAEAANVTGPDGVPVEGSR

SEQ ID NO: 4860 - protein, 12 aa, Artificial Sequence
  Synthetic Peptide
EAISLATDALKR

SEQ ID NO: 4861 - protein, 29 aa, Artificial Sequence
  Synthetic Peptide
RPGVAPERAEVVMAAAAAGAAVGKPFACR

SEQ ID NO: 4862 - protein, 20 aa, Artificial Sequence
  Synthetic Peptide
GAQAQGAAEPSRGPPLPSAR

SEQ ID NO: 4863 - protein, 23 aa, Artificial Sequence
  Synthetic Peptide
QAQLQELTYLNGGSENADVPVVR

SEQ ID NO: 4864 - protein, 13 aa, Artificial Sequence
  Synthetic Peptide
AGDLRDTGIFLDL

SEQ ID NO: 4865 - protein, 13 aa, Artificial Sequence
  Synthetic Peptide
AVSGMQTLGLQHR

SEQ ID NO: 4866 - protein, 20 aa, Artificial Sequence
  Synthetic Peptide
MAEGAQPQQPPQLGPGAAAR

SEQ ID NO: 4867 - protein, 33 aa, Artificial Sequence
  Synthetic Peptide
MTSGSDKINYTYMLTRCIQACKTNPEYIYAPLK

SEQ ID NO: 4868 - protein, 16 aa, Artificial Sequence
  Synthetic Peptide
QNANKGTHTSLMQRLR

SEQ ID NO: 4869 - protein, 28 aa, Artificial Sequence
  Synthetic Peptide
ARGVPPTGYRPPPPPPTQETYGEYDYDD

SEQ ID NO: 4870 - protein, 42 aa, Artificial Sequence
  Synthetic Peptide
WPDLQHAVELKPLCGCHSFAAAADGPTVCCNPYHFSRLCGPE

SEQ ID NO: 4871 - protein, 24 aa, Artificial Sequence
  Synthetic Peptide
FVWGSHLARHQQTHTGERPYSCLK

SEQ ID NO: 4872 - protein, 25 aa, Artificial Sequence
  Synthetic Peptide
YESYGNSRSAPLTRGPPPSYGGSSR

SEQ ID NO: 4873 - protein, 15 aa, Artificial Sequence
  Synthetic Peptide
TDLRMMMPVVDPVVR

SEQ ID NO: 4874 - protein, 15 aa, Artificial Sequence
  Synthetic Peptide
YNFMCNSSCVGGMNR

SEQ ID NO: 4875 - protein, 31 aa, Artificial Sequence
  Synthetic Peptide
DPCESGNFRVHTVMTLEQQDMVCYTAQTLVR

SEQ ID NO: 4876 - protein, 8 aa, Artificial Sequence
  Synthetic Peptide
RPAPAAAR

SEQ ID NO: 4877 - protein, 35 aa, Artificial Sequence
  Synthetic Peptide
NSSWPPFQDLPLSSSMTPASSSSRPDRETRASVIK

SEQ ID NO: 4878 - protein, 50 aa, Artificial Sequence
  Synthetic Peptide
SPGFLSGAAEGEDGDGPDVDGLAASTLLQQMMSSVGRAGAAAGDSDEESR

SEQ ID NO: 4879 - protein, 14 aa, Artificial Sequence
  Synthetic Peptide
RRPRPPNAPSQDGK

SEQ ID NO: 4880 - protein, 35 aa, Artificial Sequence
  Synthetic Peptide
NTGEEGMAAGLLTAGPRGSTFFSSVTVAFAQERWR

SEQ ID NO: 4881 - protein, 15 aa, Artificial Sequence
  Synthetic Peptide
GEKPFACTWPGCGWR

SEQ ID NO: 4882 - protein, 50 aa, Artificial Sequence
  Synthetic Peptide
LQAMMAHLHMRPSEPKPFSQPLNPVPGSSSFSKVTVSAADSFPDGLVHPP

SEQ ID NO: 4883 - protein, 18 aa, Artificial Sequence
  Synthetic Peptide
TFGNSTLALGPGESLPHR

SEQ ID NO: 4884 - protein, 16 aa, Artificial Sequence
  Synthetic Peptide
NIFESCVRNPVENIMK

SEQ ID NO: 4885 - protein, 29 aa, Artificial Sequence
  Synthetic Peptide
GPPMVPPYQGGPPRPPMGMRPPVMSQGGR

SEQ ID NO: 4886 - protein, 18 aa, Artificial Sequence
  Synthetic Peptide
LQVDLGEPAPAPPAADSR

SEQ ID NO: 4887 - protein, 8 aa, Artificial Sequence
  Synthetic Peptide
ESMLRAHR

SEQ ID NO: 4888 - protein, 33 aa, Artificial Sequence
  Synthetic Peptide
QTQSLGGPPLEHEVPGHPPGGDMGQQMNMMIQR

SEQ ID NO: 4889 - protein, 16 aa, Artificial Sequence
  Synthetic Peptide
EDGDSSEMDDEDCERR

SEQ ID NO: 4890 - protein, 27 aa, Artificial Sequence
  Synthetic Peptide
QFLDTNETPYFMKSIDCIRAFREEAIK

SEQ ID NO: 4891 - protein, 32 aa, Artificial Sequence
  Synthetic Peptide
AAAAGPLDGKVAALAASPASVAVDSGSELNSR

SEQ ID NO: 4892 - protein, 51 aa, Artificial Sequence
  Synthetic Peptide
MSDLPLTSETSSVSSMLLTSETTFVSSLPLPSETSPISNSSINERMAHQQR

SEQ ID NO: 4893 - protein, 30 aa, Artificial Sequence
  Synthetic Peptide
VDVVHMDENSLEFDMVGIDAAIANAFRRIL

SEQ ID NO: 4894 - protein, 33 aa, Artificial Sequence
  Synthetic Peptide
GPGLSLGDTALQNLEQLLDGPEAQGSWAELAER

SEQ ID NO: 4895 - protein, 13 aa, Artificial Sequence
  Synthetic Peptide
RLSEGRGLPPPPR

SEQ ID NO: 4896 - protein, 22 aa, Artificial Sequence
  Synthetic Peptide
QLESWEEPFMPAWEVVTSAILR

SEQ ID NO: 4897 - protein, 15 aa, Artificial Sequence
  Synthetic Peptide
SFEFDVELPQLAEMR

SEQ ID NO: 4898 - protein, 8 aa, Artificial Sequence
  Synthetic Peptide
PSHHPHAR

SEQ ID NO: 4899 - protein, 38 aa, Artificial Sequence
  Synthetic Peptide
KAGRSDSSSSGGGGSPSEASGLGLDFEDSVWKPEVNPD

SEQ ID NO: 4900 - protein, 14 aa, Artificial Sequence
  Synthetic Peptide
ANFVEAMADAGILR

SEQ ID NO: 4901 - protein, 12 aa, Artificial Sequence
  Synthetic Peptide
RIILTGTPLQNN

SEQ ID NO: 4902 - protein, 24 aa, Artificial Sequence
  Synthetic Peptide
NWQLLAVNHPGYMAFLTYDEVQER

SEQ ID NO: 4903 - protein, 25 aa, Artificial Sequence
  Synthetic Peptide
TPLSRPAYGMASEVQLMNASTQTDI

SEQ ID NO: 4904 - protein, 19 aa, Artificial Sequence
  Synthetic Peptide
YSRQGRVARAGTRGAQQSR

SEQ ID NO: 4905 - protein, 22 aa, Artificial Sequence
  Synthetic Peptide
TEELEALITDPDEMRMQALLIR

SEQ ID NO: 4906 - protein, 19 aa, Artificial Sequence
  Synthetic Peptide
LLEIPRPSMAATGVSMCLY

SEQ ID NO: 4907 - protein, 20 aa, Artificial Sequence
  Synthetic Peptide
QMLTESCKNRLIQMAYESQR

SEQ ID NO: 4908 - protein, 32 aa, Artificial Sequence
  Synthetic Peptide
SPAFAYCGHSFCCTGTALRTMSSLPESSAMCR

SEQ ID NO: 4909 - protein, 21 aa, Artificial Sequence
  Synthetic Peptide
SSAMANGNWEEAKELAQCAKR

SEQ ID NO: 4910 - protein, 22 aa, Artificial Sequence
  Synthetic Peptide
EAIPLPCMCVTRELTKEGRSLR

SEQ ID NO: 4911 - protein, 24 aa, Artificial Sequence
  Synthetic Peptide
VAGMGMDPSTAGGVPFGLYTPASR

SEQ ID NO: 4912 - protein, 19 aa, Artificial Sequence
  Synthetic Peptide
DPSSEPTSPASTPSTRSPR

SEQ ID NO: 4913 - protein, 14 aa, Artificial Sequence
  Synthetic Peptide
QLLPSLQSPQERER

SEQ ID NO: 4914 - protein, 12 aa, Artificial Sequence
  Synthetic Peptide
QHHHRPPPGGPQ

SEQ ID NO: 4915 - protein, 29 aa, Artificial Sequence
  Synthetic Peptide
GVEWTRMEWNGIELTRMEWNVTEWNELER

SEQ ID NO: 4916 - protein, 19 aa, Artificial Sequence
  Synthetic Peptide
GRWDQPPLDSLGMDHLPKS

SEQ ID NO: 4917 - protein, 20 aa, Artificial Sequence
  Synthetic Peptide
GEELPGARLPGGGGDDGAGR

SEQ ID NO: 4918 - protein, 29 aa, Artificial Sequence
  Synthetic Peptide
GGPVSRSPGAPSAGEAEARPSPSTTPLPD

SEQ ID NO: 4919 - protein, 19 aa, Artificial Sequence
  Synthetic Peptide
ADGGTPTDRYNSYNRPRPK

SEQ ID NO: 4920 - protein, 24 aa, Artificial Sequence
  Synthetic Peptide
VLRALRPGTVADAEDNEDENEDHK

SEQ ID NO: 4921 - protein, 12 aa, Artificial Sequence
  Synthetic Peptide
ECNGMEWNGINR

SEQ ID NO: 4922 - protein, 19 aa, Artificial Sequence
  Synthetic Peptide
LSCAASGFTFSSYGMHWVR

SEQ ID NO: 4923 - protein, 24 aa, Artificial Sequence
  Synthetic Peptide
AMESGRVSSIRFENMNVICGTAGR

SEQ ID NO: 4924 - protein, 18 aa, Artificial Sequence
  Synthetic Peptide
ASRARDSNMVRAAAELAL

SEQ ID NO: 4925 - protein, 21 aa, Artificial Sequence
  Synthetic Peptide
EAAPSQVRPREPMSVLMMANR

SEQ ID NO: 4926 - protein, 20 aa, Artificial Sequence
  Synthetic Peptide
LAPGLSPSQRPGGSSSACSR

SEQ ID NO: 4927 - protein, 11 aa, Artificial Sequence
  Synthetic Peptide
SPVEGLGRAHR

SEQ ID NO: 4928 - protein, 16 aa, Artificial Sequence
  Synthetic Peptide
ARPMGLFILQHLDPCR

SEQ ID NO: 4929 - protein, 11 aa, Artificial Sequence
  Synthetic Peptide
ISAEETVARGK

SEQ ID NO: 4930 - protein, 30 aa, Artificial Sequence
  Synthetic Peptide
TTSVANAASISGHVLRPSGCAGGWDLKPSR

SEQ ID NO: 4931 - protein, 26 aa, Artificial Sequence
  Synthetic Peptide
NEQAHPASATSTTPLGPVPAFRAGEE

SEQ ID NO: 4932 - protein, 22 aa, Artificial Sequence
  Synthetic Peptide
IMVGKAVEHIFETEEGSKNEWR

SEQ ID NO: 4933 - protein, 13 aa, Artificial Sequence
  Synthetic Peptide
RCYNCISDCPNLR

SEQ ID NO: 4934 - protein, 19 aa, Artificial Sequence
  Synthetic Peptide
RPRVDPVLADRSAAEMSGR

SEQ ID NO: 4935 - protein, 37 aa, Artificial Sequence
  Synthetic Peptide
DHKGEATVHMDTFQVARIAYCTADHNVSPNIFAWVYR

SEQ ID NO: 4936 - protein, 23 aa, Artificial Sequence
  Synthetic Peptide
GRRSFIFKGEDNWAELMEVNHDD

SEQ ID NO: 4937 - protein, 17 aa, Artificial Sequence
  Synthetic Peptide
FFPIWDITTWPGNQRDF

SEQ ID NO: 4938 - protein, 11 aa, Artificial Sequence
  Synthetic Peptide
NTLYLQMNSLR

SEQ ID NO: 4939 - protein, 12 aa, Artificial Sequence
  Synthetic Peptide
DASAEMFPMPRG

SEQ ID NO: 4940 - protein, 23 aa, Artificial Sequence
  Synthetic Peptide
DHDDHEDNDKMNDSEGMDPERLK

SEQ ID NO: 4941 - protein, 11 aa, Artificial Sequence
  Synthetic Peptide
AAALTGRTHQR

SEQ ID NO: 4942 - protein, 33 aa, Artificial Sequence
  Synthetic Peptide
VLFFVFGVLSLMSTVPPRRSFISNDECPSEYYH

SEQ ID NO: 4943 - protein, 20 aa, Artificial Sequence
  Synthetic Peptide
GLTEDSFYRTANSEHFEGEK

SEQ ID NO: 4944 - protein, 11 aa, Artificial Sequence
  Synthetic Peptide
DQPGRRSQMLR

SEQ ID NO: 4945 - protein, 10 aa, Artificial Sequence
  Synthetic Peptide
PGPRGSTPGR

SEQ ID NO: 4946 - protein, 16 aa, Artificial Sequence
  Synthetic Peptide
VGEPGRGGLGNPATDR

SEQ ID NO: 4947 - protein, 29 aa, Artificial Sequence
  Synthetic Peptide
ARLAAGFYGSGRPAPLYDLGWYRPSGQMY

SEQ ID NO: 4948 - protein, 14 aa, Artificial Sequence
  Synthetic Peptide
SLSSSATPLSSPAR

SEQ ID NO: 4949 - protein, 18 aa, Artificial Sequence
  Synthetic Peptide
EEAAEWAEWARMEKMMRP

SEQ ID NO: 4950 - protein, 11 aa, Artificial Sequence
  Synthetic Peptide
LTPPPPPLPSR

SEQ ID NO: 4951 - protein, 22 aa, Artificial Sequence
  Synthetic Peptide
VRSTGPGGSFAKHMVAQCVSPK

SEQ ID NO: 4952 - protein, 20 aa, Artificial Sequence
  Synthetic Peptide
EWNGMEWKGMESNRVEWYGK

SEQ ID NO: 4953 - protein, 23 aa, Artificial Sequence
  Synthetic Peptide
QNREEFRRLLYFMAVAANPSEFK

SEQ ID NO: 4954 - protein, 8 aa, Artificial Sequence
  Synthetic Peptide
VRVRMDPQ

SEQ ID NO: 4955 - protein, 24 aa, Artificial Sequence
  Synthetic Peptide
QACTMSHHSAASHDGAQPLRVLFR

SEQ ID NO: 4956 - protein, 16 aa, Artificial Sequence
  Synthetic Peptide
EAYGDEVMSRARVFDW

SEQ ID NO: 4957 - protein, 13 aa, Artificial Sequence
  Synthetic Peptide
EANDHTQAAGGMR

SEQ ID NO: 4958 - protein, 13 aa, Artificial Sequence
  Synthetic Peptide
IRYWDLKSGVCTR

SEQ ID NO: 4959 - protein, 11 aa, Artificial Sequence
  Synthetic Peptide
FKPLLDAGDPR

SEQ ID NO: 4960 - protein, 21 aa, Artificial Sequence
  Synthetic Peptide
TPPPRPSPLEAGSDGCEEPKQ

SEQ ID NO: 4961 - protein, 7 aa, Artificial Sequence
  Synthetic Peptide
AHYKREM

SEQ ID NO: 4962 - protein, 17 aa, Artificial Sequence
  Synthetic Peptide
FSAPDIGSKGMNQVPGR

SEQ ID NO: 4963 - protein, 21 aa, Artificial Sequence
  Synthetic Peptide
VEQTAESCEVQEMLKVARAEK

SEQ ID NO: 4964 - protein, 18 aa, Artificial Sequence
  Synthetic Peptide
IPSLFEIVVRPTGQLAEK

SEQ ID NO: 4965 - protein, 22 aa, Artificial Sequence
  Synthetic Peptide
TPGSGTGSGLQAPRPALTLSLL

SEQ ID NO: 4966 - protein, 23 aa, Artificial Sequence
  Synthetic Peptide
PTASGHRPEEDEEEEIVIGWQEK

SEQ ID NO: 4967 - protein, 31 aa, Artificial Sequence
  Synthetic Peptide
NMPRTKSHPGCGDTVGLIDEQNEASKTNGLG

SEQ ID NO: 4968 - protein, 14 aa, Artificial Sequence
  Synthetic Peptide
VFDTALGMAGSREL

SEQ ID NO: 4969 - protein, 14 aa, Artificial Sequence
  Synthetic Peptide
RSSSCGSTGSSHQS

SEQ ID NO: 4970 - protein, 35 aa, Artificial Sequence
  Synthetic Peptide
EHPCWEGGRGPARPTVCSPSSQPSLGSSTKFPSHR

SEQ ID NO: 4971 - protein, 39 aa, Artificial Sequence
  Synthetic Peptide
GLRHPNCMLVNIGLEECMLTSACCRSLASVLTTNKTLER

SEQ ID NO: 4972 - protein, 26 aa, Artificial Sequence
  Synthetic Peptide
MKCYFTDHRGEQSPTDGTTLSLTSPE

SEQ ID NO: 4973 - protein, 21 aa, Artificial Sequence
  Synthetic Peptide
RLDARTGAFIGEQWGVGTVGR

SEQ ID NO: 4974 - protein, 22 aa, Artificial Sequence
  Synthetic Peptide
MDVMSQNYRNPVFLGIVFSKPD

SEQ ID NO: 4975 - protein, 18 aa, Artificial Sequence
  Synthetic Peptide
EWNGMESNRMEWNGMEWK

SEQ ID NO: 4976 - protein, 14 aa, Artificial Sequence
  Synthetic Peptide
WGLGEVVGSMQQVR

SEQ ID NO: 4977 - protein, 31 aa, Artificial Sequence
  Synthetic Peptide
MPAVCSPGMVPVALPPAAVNAQPRCSEEDLK

SEQ ID NO: 4978 - protein, 51 aa, Artificial Sequence
  Synthetic Peptide
ACIGFGGNLVSIQNEKEQAFLTYHMKDSTFSAWTGLNDVNSEHTFLWTDGR

SEQ ID NO: 4979 - protein, 23 aa, Artificial Sequence
  Synthetic Peptide
ESHQREIPLPSLSKYEAQGSLTK

SEQ ID NO: 4980 - protein, 30 aa, Artificial Sequence
  Synthetic Peptide
YEKLVLEMVHHNTASLEKLVDTAWLEIMTK

SEQ ID NO: 4981 - protein, 17 aa, Artificial Sequence
  Synthetic Peptide
QLNYKHYDGSYSTFGER

SEQ ID NO: 4982 - protein, 11 aa, Artificial Sequence
  Synthetic Peptide
IKTQEKAPVKK

SEQ ID NO: 4983 - protein, 15 aa, Artificial Sequence
  Synthetic Peptide
GTHCQQCPSCYALVK

SEQ ID NO: 4984 - protein, 37 aa, Artificial Sequence
  Synthetic Peptide
LIGDMREQLSDHFKDVMAGLMYPPPLYDAHELWHAMK

SEQ ID NO: 4985 - protein, 12 aa, Artificial Sequence
  Synthetic Peptide
AETGDKVYVHLK

SEQ ID NO: 4986 - protein, 18 aa, Artificial Sequence
  Synthetic Peptide
PTSPPPASPPPTPGITRK

SEQ ID NO: 4987 - protein, 29 aa, Artificial Sequence
  Synthetic Peptide
LTGPAGEPGREGSPGADGPPGRDGAAGVK

SEQ ID NO: 4988 - protein, 20 aa, Artificial Sequence
  Synthetic Peptide
SGLSTGWTQLSKLLELTGPK

SEQ ID NO: 4989 - protein, 10 aa, Artificial Sequence
  Synthetic Peptide
QMSKYPSGER

SEQ ID NO: 4990 - protein, 25 aa, Artificial Sequence
  Synthetic Peptide
KGIQFLIENDLLQSSPEDVAQFLYK

SEQ ID NO: 4991 - protein, 12 aa, Artificial Sequence
  Synthetic Peptide
QPSSAFAAFVKR

SEQ ID NO: 4992 - protein, 11 aa, Artificial Sequence
  Synthetic Peptide
SKAVAPGDKPK

SEQ ID NO: 4993 - protein, 13 aa, Artificial Sequence
  Synthetic Peptide
KGKKDDNGIGTAI

SEQ ID NO: 4994 - protein, 12 aa, Artificial Sequence
  Synthetic Peptide
ELGQSQKEQGLS

SEQ ID NO: 4995 - protein, 9 aa, Artificial Sequence
  Synthetic Peptide
NYAKLPAKH

SEQ ID NO: 4996 - protein, 25 aa, Artificial Sequence
  Synthetic Peptide
SHSTQTLTCNSDGEWVYNTFCIYKR

SEQ ID NO: 4997 - protein, 12 aa, Artificial Sequence
  Synthetic Peptide
KPVEQKKIFTIQ

SEQ ID NO: 4998 - protein, 14 aa, Artificial Sequence
  Synthetic Peptide
SSGQMAQKFSFSKV

SEQ ID NO: 4999 - protein, 13 aa, Artificial Sequence
  Synthetic Peptide
AATGECTATVGKR

SEQ ID NO: 5000 - protein, 32 aa, Artificial Sequence
  Synthetic Peptide
LHLCAETKDDALAWKTALLEANSTPVRVYSPY

SEQ ID NO: 5001 - protein, 25 aa, Artificial Sequence
  Synthetic Peptide
NALFCLESAWKTAQEGDHGSHVYTK

SEQ ID NO: 5002 - protein, 36 aa, Artificial Sequence
  Synthetic Peptide
GFTSLGMEEERIETAQQFFSWFAKLQTQMDQDEGTK

SEQ ID NO: 5003 - protein, 19 aa, Artificial Sequence
  Synthetic Peptide
VKTASKLCSALTLSGLVEV

SEQ ID NO: 5004 - protein, 25 aa, Artificial Sequence
  Synthetic Peptide
NALFCLESAWKTAQEGDHGSHVYTK

SEQ ID NO: 5005 - protein, 22 aa, Artificial Sequence
  Synthetic Peptide
QGHNSVFLIKGDKVWVYPPEKK

SEQ ID NO: 5006 - protein, 38 aa, Artificial Sequence
  Synthetic Peptide
GNVFCAGCCHLKLPIPDQQLYDPVLVCNSCYEHIQVSR

SEQ ID NO: 5007 - protein, 24 aa, Artificial Sequence
  Synthetic Peptide
SSSNEEVMFLTVQVKGPTQEFKKR

SEQ ID NO: 5008 - protein, 16 aa, Artificial Sequence
  Synthetic Peptide
ALLAYAFALAGNQDKR

SEQ ID NO: 5009 - protein, 32 aa, Artificial Sequence
  Synthetic Peptide
TVPVKAQAQPIQLTDLYPGMTYTLRVYSRDNE

SEQ ID NO: 5010 - protein, 13 aa, Artificial Sequence
  Synthetic Peptide
EVLKSLNEEAVKK

SEQ ID NO: 5011 - protein, 16 aa, Artificial Sequence
  Synthetic Peptide
MSSVQKMMQAGKKFKD

SEQ ID NO: 5012 - protein, 33 aa, Artificial Sequence
  Synthetic Peptide
ETYGEMADCCAKQEPERNECFLQHKDDNPNLPR

SEQ ID NO: 5013 - protein, 11 aa, Artificial Sequence
  Synthetic Peptide
QKFQSVFTVTR

SEQ ID NO: 5014 - protein, 41 aa, Artificial Sequence
  Synthetic Peptide
GNLEGQEASQEGLYMCVKITCEEKATESHSTSSTFHRIIPT

SEQ ID NO: 5015 - protein, 22 aa, Artificial Sequence
  Synthetic Peptide
SLNEEAVKKDNSVHWERPQKPK

SEQ ID NO: 5016 - protein, 36 aa, Artificial Sequence
  Synthetic Peptide
DLYPDATEGDLYTDMSKVDGVLSLNVGCIQIVYLHK

SEQ ID NO: 5017 - protein, 22 aa, Artificial Sequence
  Synthetic Peptide
SLNEEAVKKDNSVHWERPQKPK

SEQ ID NO: 5018 - protein, 18 aa, Artificial Sequence
  Synthetic Peptide
VKSDPLGHPNSEETVKAK

SEQ ID NO: 5019 - protein, 28 aa, Artificial Sequence
  Synthetic Peptide
SCGLHQLLRGPEVQLVAHSPWLKDSLSR

SEQ ID NO: 5020 - protein, 13 aa, Artificial Sequence
  Synthetic Peptide
DNSVHWERPQKPK

SEQ ID NO: 5021 - protein, 17 aa, Artificial Sequence
  Synthetic Peptide
KEVQGRSGDGANAGGLV

SEQ ID NO: 5022 - protein, 18 aa, Artificial Sequence
  Synthetic Peptide
NKTRESAKPEISAMSAHD

SEQ ID NO: 5023 - protein, 9 aa, Artificial Sequence
  Synthetic Peptide
EQEKMTMNK

SEQ ID NO: 5024 - protein, 44 aa, Artificial Sequence
  Synthetic Peptide
LPEFKFWHAATKGILVAMVCTFFDAFNVPVFWPILVMYFIMLFC

SEQ ID NO: 5025 - protein, 14 aa, Artificial Sequence
  Synthetic Peptide
LKGPLLNKFLTTAK

SEQ ID NO: 5026 - protein, 21 aa, Artificial Sequence
  Synthetic Peptide
ILLEESKEYRPGNWEAGNKLK

SEQ ID NO: 5027 - protein, 12 aa, Artificial Sequence
  Synthetic Peptide
GDKVWVYPPEKK

SEQ ID NO: 5028 - protein, 22 aa, Artificial Sequence
  Synthetic Peptide
TNASIKFNPGAESVVLSNSTLK

SEQ ID NO: 5029 - protein, 14 aa, Artificial Sequence
  Synthetic Peptide
TDLAGTKPLTQLAK

SEQ ID NO: 5030 - protein, 19 aa, Artificial Sequence
  Synthetic Peptide
HFANQPLIGSETGTLMVLK

SEQ ID NO: 5031 - protein, 10 aa, Artificial Sequence
  Synthetic Peptide
KPFVCKECGK

SEQ ID NO: 5032 - protein, 31 aa, Artificial Sequence
  Synthetic Peptide
QQNAQGGFSSTQDTVVALHALSKYGAATFTR

SEQ ID NO: 5033 - protein, 16 aa, Artificial Sequence
  Synthetic Peptide
ADGKKMVALLIEYVCK

SEQ ID NO: 5034 - protein, 8 aa, Artificial Sequence
  Synthetic Peptide
LNTKFLED

SEQ ID NO: 5035 - protein, 11 aa, Artificial Sequence
  Synthetic Peptide
VQPYLDDFQKK

SEQ ID NO: 5036 - protein, 33 aa, Artificial Sequence; identical to SEQ ID NO: 5012
  Synthetic Peptide

SEQ ID NO: 5037 - protein, 16 aa, Artificial Sequence
  Synthetic Peptide
GKVQALQPIALDLKTS

SEQ ID NO: 5038 - protein, 30 aa, Artificial Sequence
  Synthetic Peptide
VSKMRMATPLLMQALPMGALPQGPMQNATK

SEQ ID NO: 5039 - protein, 22 aa, Artificial Sequence
  Synthetic Peptide
TPKKPVNSKLGLSPYLTPYNDS

SEQ ID NO: 5040 - protein, 31 aa, Artificial Sequence
  Synthetic Peptide
QEVKKLGGYLQLFLQGCCLDISSMIKEAQKN

SEQ ID NO: 5041 - protein, 14 aa, Artificial Sequence
  Synthetic Peptide
GIAEFWINGTPLVK

SEQ ID NO: 5042 - protein, 13 aa, Artificial Sequence
  Synthetic Peptide
AKDQLTCNKFDLK

SEQ ID NO: 5043 - protein, 29 aa, Artificial Sequence
  Synthetic Peptide
RNIFDLCTDTKDCYLAVIENQGSMDALNM

SEQ ID NO: 5044 - protein, 13 aa, Artificial Sequence
  Synthetic Peptide
KFSRHHGPTITAK

SEQ ID NO: 5045 - protein, 33 aa, Artificial Sequence
  Synthetic Peptide
VSLLLYDHTLVTEPNSPQDSKSMELEANVKLVR

SEQ ID NO: 5046 - protein, 13 aa, Artificial Sequence
  Synthetic Peptide
FIENNNTKHTTAR

SEQ ID NO: 5047 - protein, 12 aa, Artificial Sequence
  Synthetic Peptide
WQKPYTSVASGK

SEQ ID NO: 5048 - protein, 13 aa, Artificial Sequence
  Synthetic Peptide
MVSGFIPLKPTVK

SEQ ID NO: 5049 - protein, 17 aa, Artificial Sequence
  Synthetic Peptide
MVSGFIPLKPTVKMLER

SEQ ID NO: 5050 - protein, 23 aa, Artificial Sequence
  Synthetic Peptide
KTDDLTMVLYSPGPKQASFTDVR

SEQ ID NO: 5051 - protein, 12 aa, Artificial Sequence
  Synthetic Peptide
QGEKQLFEKFWR

SEQ ID NO: 5052 - protein, 38 aa, Artificial Sequence
  Synthetic Peptide
DMKDGMDNNHNWNTHGDPVEDPDHTEEVSNLVNYVLKK

SEQ ID NO: 5053 - protein, 12 aa, Artificial Sequence
  Synthetic Peptide
LKLRLASLSQLR

SEQ ID NO: 5054 - protein, 47 aa, Artificial Sequence
  Synthetic Peptide
AETLAVEIKELQGQLADYNMLVDKLNTNTEMEEVMNDYNMLKAQNDR

SEQ ID NO: 5055 - protein, 12 aa, Artificial Sequence
  Synthetic Peptide
SIYKPGQTVKFR

SEQ ID NO: 5056 - protein, 36 aa, Artificial Sequence
  Synthetic Peptide
EMVVQYISATAKSGGLKNSKHECTLSSQEYVHELRS

SEQ ID NO: 5057 - protein, 13 aa, Artificial Sequence
  Synthetic Peptide
HHGPTITAKLYGR

SEQ ID NO: 5058 - protein, 13 aa, Artificial Sequence
  Synthetic Peptide
FYHPEKEDGKLNK

SEQ ID NO: 5059 - protein, 29 aa, Artificial Sequence
  Synthetic Peptide
MQSVAAFAVSAVASQWERTGKPFNPLLGE

SEQ ID NO: 5060 - protein, 25 aa, Artificial Sequence
  Synthetic Peptide
EDFKYCWENFVYNDNEPFKPWKGLK

SEQ ID NO: 5061 - protein, 41 aa, Artificial Sequence
  Synthetic Peptide
SRMEQMSLMALADTIATTSTDIGESRDRSQGGETLDECGLK

SEQ ID NO: 5062 - protein, 16 aa, Artificial Sequence
  Synthetic Peptide
LDKACEPGVDYVYKTR

SEQ ID NO: 5063 - protein, 14 aa, Artificial Sequence
  Synthetic Peptide
TSKKITIADCGQLE

SEQ ID NO: 5064 - protein, 13 aa, Artificial Sequence
  Synthetic Peptide
IFTVNHKLLPVGR

SEQ ID NO: 5065 - protein, 37 aa, Artificial Sequence
  Synthetic Peptide
VHGCFNASIPKPEQLSAEQWQTMEINMGDELEFEVFR

SEQ ID NO: 5066 - protein, 12 aa, Artificial Sequence
  Synthetic Peptide
AKENMEKEKPVK

SEQ ID NO: 5067 - protein, 37 aa, Artificial Sequence
  Synthetic Peptide
ATLVCLISDFYPGAVTVAWKADGSPVKAGVETTKPSK

SEQ ID NO: 5068 - protein, 37 aa, Artificial Sequence
  Synthetic Peptide
VQRVSCCFSLLLCTMLTSIMFWGVPKDPAEQKMDLGK

SEQ ID NO: 5069 - protein, 9 aa, Artificial Sequence
  Synthetic Peptide
TFISPIKCR

SEQ ID NO: 5070 - protein, 15 aa, Artificial Sequence
  Synthetic Peptide
IGNLKGTEIFHLIKK

SEQ ID NO: 5071 - protein, 11 aa, Artificial Sequence
  Synthetic Peptide
LVDKFLEDVKK

SEQ ID NO: 5072 - protein, 9 aa, Artificial Sequence
  Synthetic Peptide
EALKLEEKK

SEQ ID NO: 5073 - protein, 23 aa, Artificial Sequence
  Synthetic Peptide
LVRPEVDVMCTAFHDNEETFLKK

SEQ ID NO: 5074 - protein, 23 aa, Artificial Sequence
  Synthetic Peptide
LVRPEVDVMCTAFHDNEETFLKK

SEQ ID NO: 5075 - protein, 33 aa, Artificial Sequence
  Synthetic Peptide
DIDTAKSMLALLLGRTWPLFSVFYQYLEQSKYR

SEQ ID NO: 5076 - protein, 18 aa, Artificial Sequence
  Synthetic Peptide
QKLHELQEKLSPLGEEMR

SEQ ID NO: 5077 - protein, 28 aa, Artificial Sequence
  Synthetic Peptide
SGTNPSSSASTTAMPVTQSVKKPSKPVK

SEQ ID NO: 5078 - protein, 16 aa, Artificial Sequence
  Synthetic Peptide
SSKRDQELAFQGTVDK

SEQ ID NO: 5079 - protein, 20 aa, Artificial Sequence
  Synthetic Peptide
SSLPFLDPNARPLVPEVSIK

SEQ ID NO: 5080 - protein, 14 aa, Artificial Sequence
  Synthetic Peptide
MEDFVTWVDSSKIK

SEQ ID NO: 5081 - protein, 30 aa, Artificial Sequence
  Synthetic Peptide
AGVETTKPSKQSNNKYAASSYLSLTPEQWK

SEQ ID NO: 5082 - protein, 10 aa, Artificial Sequence
  Synthetic Peptide
TAQGSLSLKA

SEQ ID NO: 5083 - protein, 12 aa, Artificial Sequence
  Synthetic Peptide
ITQVLHFTKDVK

SEQ ID NO: 5084 - protein, 12 aa, Artificial Sequence
  Synthetic Peptide
VLEKQQGNFKAT

SEQ ID NO: 5085 - protein, 29 aa, Artificial Sequence
  Synthetic Peptide
GVGKPGMPGMPGKPGAMGMPGAKGEIGQK

SEQ ID NO: 5086 - protein, 17 aa, Artificial Sequence
  Synthetic Peptide
ILGGHLDAKGSFPWQAK

SEQ ID NO: 5087 - protein, 33 aa, Artificial Sequence
  Synthetic Peptide
DPAGHSQTTVPCVTHAGFCCPLVVTMRPIPKDK

SEQ ID NO: 5088 - protein, 53 aa, Artificial Sequence
  Synthetic Peptide
PQKIPNKPEFEDSNPSPLPPDMAPGQSYQPQSESASSSSMDKYHIHHISEPTR

SEQ ID NO: 5089 - protein, 21 aa, Artificial Sequence
  Synthetic Peptide
MVTVCPNTESCESITLKDVAV

SEQ ID NO: 5090 - protein, 12 aa, Artificial Sequence
  Synthetic Peptide
VKDVTTQGELIK

SEQ ID NO: 5091 - protein, 12 aa, Artificial Sequence
  Synthetic Peptide
NILTSNNIDVKK

SEQ ID NO: 5092 - protein, 51 aa, Artificial Sequence
  Synthetic Peptide
MHLNPDGTDHKDNGKPPTLVTSMIDYNMPITMAYMKHMKLQLLNSQQDEDE

SEQ ID NO: 5093 - protein, 22 aa, Artificial Sequence
  Synthetic Peptide
TQMKKVMLTVFKHNHGAYQFFR

SEQ ID NO: 5094 - protein, 30 aa, Artificial Sequence
  Synthetic Peptide
EYDRAACGRIHYTEMYEMLTLMSPPLGLGK

SEQ ID NO: 5095 - protein, 15 aa, Artificial Sequence
  Synthetic Peptide
YFPIRFPDVSRFMPK

SEQ ID NO: 5096 - protein, 32 aa, Artificial Sequence
  Synthetic Peptide
KPNISYQQELPDSHLTEEALKVSNVPGPADQK

SEQ ID NO: 5097 - protein, 31 aa, Artificial Sequence
  Synthetic Peptide
FDEVTKDYMVISWKPPLDDGGSKITNYIIEK

SEQ ID NO: 5098 - protein, 43 aa, Artificial Sequence
  Synthetic Peptide
EAGGNPKQAAHTQEALEEAVQMMTEAVEDLTTTLNEAASAAGV

SEQ ID NO: 5099 - protein, 10 aa, Artificial Sequence
  Synthetic Peptide
SDVVYTDWKK

SEQ ID NO: 5100 - protein, 37 aa, Artificial Sequence
  Synthetic Peptide
MTVPGGFRSCTETDISSKIFINSTLTPPAGSERHYDA

SEQ ID NO: 5101 - protein, 9 aa, Artificial Sequence
  Synthetic Peptide
TYCSSFKLF

SEQ ID NO: 5102 - protein, 32 aa, Artificial Sequence
  Synthetic Peptide
KMIAASWIFDAGFVTPVLFFYGSNWDSHCNYF

SEQ ID NO: 5103 - protein, 14 aa, Artificial Sequence
  Synthetic Peptide
KLSMGGLHSSRPLK

SEQ ID NO: 5104 - protein, 16 aa, Artificial Sequence
  Synthetic Peptide
RHPYFYAPELLFFAKR

SEQ ID NO: 5105 - protein, 23 aa, Artificial Sequence
  Synthetic Peptide
LPVVVVANKQDLSEAMSMGELQR

SEQ ID NO: 5106 - protein, 22 aa, Artificial Sequence
  Synthetic Peptide
RYKAAFTECCQAADKAACLLPK

SEQ ID NO: 5107 - protein, 27 aa, Artificial Sequence
  Synthetic Peptide
VLGESGEMDALKIQMEEKFMAANPSKI

SEQ ID NO: 5108 - protein, 33 aa, Artificial Sequence
  Synthetic Peptide
AGVETTKPSKQSNNKYAASSYLSLTPEQWKSHR

SEQ ID NO: 5109 - protein, 14 aa, Artificial Sequence
  Synthetic Peptide
DKCEPLEKQHEKER

SEQ ID NO: 5110 - protein, 23 aa, Artificial Sequence
  Synthetic Peptide
YGGPNHHLPLPDNWKSQVEPETR

SEQ ID NO: 5111 - protein, 50 aa, Artificial Sequence
  Synthetic Peptide
MDINEIFKDLGMMIHEQGDVIDSIEANVENAEVHVQQANQQLSRAADYQR

SEQ ID NO: 5112 - protein, 39 aa, Artificial Sequence
  Synthetic Peptide
SSHKTHYAVQDTKGFHTEEDIGGLHATIECEQPQPDLYK

SEQ ID NO: 5113 - protein, 25 aa, Artificial Sequence
  Synthetic Peptide
TPPISNLTKTASESISNLSEAGSIK

SEQ ID NO: 5114 - protein, 38 aa, Artificial Sequence
  Synthetic Peptide
DRHNGNIMLDKKGHIIHIDFGFMFESSPGGNLGWEPDI

SEQ ID NO: 5115 - protein, 21 aa, Artificial Sequence
  Synthetic Peptide
FLKLFITEFPKPEFMSKSLEE

SEQ ID NO: 5116 - protein, 8 aa, Artificial Sequence
  Synthetic Peptide
TLLVVVPK

SEQ ID NO: 5117 - protein, 22 aa, Artificial Sequence
  Synthetic Peptide
TQEKPYKCSDCEKGLPSSSHLR

SEQ ID NO: 5118 - protein, 31 aa, Artificial Sequence
  Synthetic Peptide
IILLLIQSVLGSIVNAFMVGCMFVKISQPKK

SEQ ID NO: 5119 - protein, 14 aa, Artificial Sequence
  Synthetic Peptide
DKCEPLEKQHEKER

SEQ ID NO: 5120 - protein, 35 aa, Artificial Sequence
  Synthetic Peptide
QMSCEMWDFDIYGDLYFEKAVNGFLADLFTKWKEK

SEQ ID NO: 5121 - protein, 20 aa, Artificial Sequence
  Synthetic Peptide
KLQPAAMYEIKVRSIPDHYF

SEQ ID NO: 5122 - protein, 20 aa, Artificial Sequence
  Synthetic Peptide
QSNNKYAASSYLSLTPEQWK

SEQ ID NO: 5123 - protein, 21 aa, Artificial Sequence
  Synthetic Peptide
DKCEPLEKQHEKERKQEEGES

SEQ ID NO: 5124 - protein, 18 aa, Artificial Sequence
  Synthetic Peptide
YAITVYRLDDSDREGSVK

SEQ ID NO: 5125 - protein, 21 aa, Artificial Sequence
  Synthetic Peptide
YKAAFTECCQAADKAACLLPK

SEQ ID NO: 5126 - protein, 15 aa, Artificial Sequence
  Synthetic Peptide
RTKTSDDSGLELDNN

SEQ ID NO: 5127 - protein, 39 aa, Artificial Sequence
  Synthetic Peptide
NMPVQLPLAHSGWLFKEENDEPDVKPWLAGPKEEDMEVD

SEQ ID NO: 5128 - protein, 34 aa, Artificial Sequence
  Synthetic Peptide
APCKQMKLEAAGGPSALNFDSPSSLFESLISPIK

SEQ ID NO: 5129 - protein, 10 aa, Artificial Sequence
  Synthetic Peptide
CQAAEPGKYR

SEQ ID NO: 5130 - protein, 6 aa, Artificial Sequence
  Synthetic Peptide
AAKPKS

SEQ ID NO: 5131 - protein, 22 aa, Artificial Sequence
  Synthetic Peptide
QFSFPLSSEPFQGSYKVVVQKK

SEQ ID NO: 5132 - protein, 22 aa, Artificial Sequence
  Synthetic Peptide
VTAINKAGPGKPSDASKAAYAR

SEQ ID NO: 5133 - protein, 10 aa, Artificial Sequence
  Synthetic Peptide
FTKKNGSTVK

SEQ ID NO: 5134 - protein, 18 aa, Artificial Sequence
  Synthetic Peptide
AQLLEIAKANAAAMCAKA

SEQ ID NO: 5135 - protein, 15 aa, Artificial Sequence
  Synthetic Peptide
LQLKHLSLLTTLSNR

SEQ ID NO: 5136 - protein, 37 aa, Artificial Sequence
  Synthetic Peptide
MRILVTGGSGLVGKAIQKVVADGAGLPGEDWVFVSSK

SEQ ID NO: 5137 - protein, 18 aa, Artificial Sequence
  Synthetic Peptide
YAASSYLSLTPEQWKSHR

SEQ ID NO: 5138 - protein, 34 aa, Artificial Sequence
  Synthetic Peptide
SINKKAKALDNSLQPKSLAASSPPPCSQPSQCPE

SEQ ID NO: 5139 - protein, 14 aa, Artificial Sequence
  Synthetic Peptide
LDELRDEGKASSAK

SEQ ID NO: 5140 - protein, 31 aa, Artificial Sequence
  Synthetic Peptide
CDLGGDFFKDPLPEADLYILARVLHDWADGK

SEQ ID NO: 5141 - protein, 18 aa, Artificial Sequence
  Synthetic Peptide
LDELRDEGKASSAKQRLK

SEQ ID NO: 5142 - protein, 16 aa, Artificial Sequence
  Synthetic Peptide
LDELRDEGKASSAKQR

SEQ ID NO: 5143 - protein, 25 aa, Artificial Sequence
  Synthetic Peptide
EGVPLVVDKDVFSVETPKKEHQPLR

SEQ ID NO: 5144 - protein, 18 aa, Artificial Sequence
  Synthetic Peptide
LILEEFKNSSKLVAAAEK

SEQ ID NO: 5145 - protein, 37 aa, Artificial Sequence
  Synthetic Peptide
SESLIQKPQEKKTDDDEITWGNDELPIERTNHEDSDK

SEQ ID NO: 5146 - protein, 31 aa, Artificial Sequence
  Synthetic Peptide
GKWERPFEVKDTEEEDFHVDQVTTVKVPMMK

SEQ ID NO: 5147 - protein, 13 aa, Artificial Sequence
  Synthetic Peptide
AVSAVVGPAAEAK

SEQ ID NO: 5148 - protein, 47 aa, Artificial Sequence
  Synthetic Peptide
FHFPLQGFPDCENFLLTKCNGSIADNSPLFGLDCEMCLTSKGRELTR

SEQ ID NO: 5149 - protein, 12 aa, Artificial Sequence
  Synthetic Peptide
GSTNYNPSLKSR

SEQ ID NO: 5150 - protein, 24 aa, Artificial Sequence
  Synthetic Peptide
QDVVAKEKDTMATFECETSEPFVK

SEQ ID NO: 5151 - protein, 18 aa, Artificial Sequence
  Synthetic Peptide
RKSDVSSSTASLALEKTE

SEQ ID NO: 5152 - protein, 16 aa, Artificial Sequence
  Synthetic Peptide
LDELRDEGKASSAKQR

SEQ ID NO: 5153 - protein, 35 aa, Artificial Sequence
  Synthetic Peptide
KIMEEGMGQTISCPAHGCDILVDDNTVMRLITDSK

SEQ ID NO: 5154 - protein, 23 aa, Artificial Sequence
  Synthetic Peptide
YHIKPNQQDISFVSFTCVTEMEK

SEQ ID NO: 5155 - protein, 18 aa, Artificial Sequence
  Synthetic Peptide
GAAVLERPVAEVAAPVVK

SEQ ID NO: 5156 - protein, 9 aa, Artificial Sequence
  Synthetic Peptide
ELAAQTIKK

SEQ ID NO: 5157 - protein, 13 aa, Artificial Sequence
  Synthetic Peptide
CNLLAEKQYGFCK

SEQ ID NO: 5158 - protein, 13 aa, Artificial Sequence
  Synthetic Peptide
DIAPTLTLYVGKK

SEQ ID NO: 5159 - protein, 23 aa, Artificial Sequence
  Synthetic Peptide
TEHPFTVEEFVLPKFEVQVTVPK

SEQ ID NO: 5160 - protein, 13 aa, Artificial Sequence
  Synthetic Peptide
DIAPTLTLYVGKK

SEQ ID NO: 5161 - protein, 23 aa, Artificial Sequence
  Synthetic Peptide
SYSCQVTHEGSTVEKTVAPTECS

SEQ ID NO: 5162 - protein, 37 aa, Artificial Sequence
  Synthetic Peptide
DKSVRNMSCSINNTLLGQKKESVIFIPESFMPSVSPC

SEQ ID NO: 5163 - protein, 25 aa, Artificial Sequence
  Synthetic Peptide
HLSLLTTLSNRVCSQYAAYGEKKSR

SEQ ID NO: 5164 - protein, 20 aa, Artificial Sequence
  Synthetic Peptide
ATEHLSTLSEKAKPALEDLR

SEQ ID NO: 5165 - protein, 11 aa, Artificial Sequence
  Synthetic Peptide
LQCLYCEKTFR

SEQ ID NO: 5166 - protein, 20 aa, Artificial Sequence
  Synthetic Peptide
ATEHLSTLSEKAKPALEDLR

SEQ ID NO: 5167 - protein, 20 aa, Artificial Sequence
  Synthetic Peptide
VGYVSGWGQSDNFKLTDHLK

SEQ ID NO: 5168 - protein, 38 aa, Artificial Sequence
  Synthetic Peptide
CPVSQRNSSFQQPGRKPGCSSWGMAVNVYSTSITQETM

SEQ ID NO: 5169 - protein, 26 aa, Artificial Sequence
  Synthetic Peptide
LAQKVPTADLEDVLPLAEDITNILSK

SEQ ID NO: 5170 - protein, 39 aa, Artificial Sequence
  Synthetic Peptide
INPEEYEHPNPWKESFQQLYKGAHVKPGFAEHFYSNPAR

SEQ ID NO: 5171 - protein, 17 aa, Artificial Sequence
  Synthetic Peptide
KIKEFLKIMGLHDTAFW

SEQ ID NO: 5172 - protein, 31 aa, Artificial Sequence
  Synthetic Peptide
GFSRHHIIKYEPIVTKGNEALVHHMEVFQCA

SEQ ID NO: 5173 - protein, 10 aa, Artificial Sequence
  Synthetic Peptide
KLIPSPKARN

SEQ ID NO: 5174 - protein, 22 aa, Artificial Sequence
  Synthetic Peptide
ALGRPTTLCETMGKAEIWLIRT

SEQ ID NO: 5175 - protein, 22 aa, Artificial Sequence
  Synthetic Peptide
YEVTDMMQKALFDFLKHRFDGR

SEQ ID NO: 5176 - protein, 14 aa, Artificial Sequence
  Synthetic Peptide
ELRPWCFTTDPNKR

SEQ ID NO: 5177 - protein, 24 aa, Artificial Sequence
  Synthetic Peptide
GMTRPLSTLISSSQSCQYTLDAKR

SEQ ID NO: 5178 - protein, 12 aa, Artificial Sequence
  Synthetic Peptide
VIALELLDVKSH

SEQ ID NO: 5179 - protein, 10 aa, Artificial Sequence
  Synthetic Peptide
LKQKVSVNER

SEQ ID NO: 5180 - protein, 20 aa, Artificial Sequence
  Synthetic Peptide
LGMFNIQHCKKLSSWVLLMK

SEQ ID NO: 5181 - protein, 22 aa, Artificial Sequence
  Synthetic Peptide
KPVDEYKDCHLAQVPSHTVVAR

SEQ ID NO: 5182 - protein, 34 aa, Artificial Sequence
  Synthetic Peptide
DIDHETVVEEQIIGENSPPDYSEYMTGKKLPPGG

SEQ ID NO: 5183 - protein, 32 aa, Artificial Sequence
  Synthetic Peptide
IYEQEGVYIHSSCGKTNDQDGLISGILRVLEK

SEQ ID NO: 5184 - protein, 26 aa, Artificial Sequence
  Synthetic Peptide
KPDVSHGEMVSGFGPIYNYKDTIVFK

SEQ ID NO: 5185 - protein, 13 aa, Artificial Sequence
  Synthetic Peptide
VSFLSALEEYTKK

SEQ ID NO: 5186 - protein, 29 aa, Artificial Sequence
  Synthetic Peptide
IASFSQNCDIYPGKDFVQPPTKICVGCPR

SEQ ID NO: 5187 - protein, 42 aa, Artificial Sequence
  Synthetic Peptide
HTLHMGSNATGSNDPSMEAHMGAIKAISYFLILYIFNAVALF

SEQ ID NO: 5188 - protein, 25 aa, Artificial Sequence
  Synthetic Peptide
YVMLPVADQYDCITHYEGSTCPKWK

SEQ ID NO: 5189 - protein, 30 aa, Artificial Sequence
  Synthetic Peptide
KQVPHIVHLIMSYAYFLFPPLMNPITYSVK

SEQ ID NO: 5190 - protein, 25 aa, Artificial Sequence
  Synthetic Peptide
YVMLPVADQYDCITHYEGSTCPKWK

SEQ ID NO: 5191 - protein, 32 aa, Artificial Sequence
  Synthetic Peptide
AKELGKCDCCSDDQAPQHGCNHKLELALSMIK

SEQ ID NO: 5192 - protein, 15 aa, Artificial Sequence
  Synthetic Peptide
KTMEIPKDSLQKYLK

SEQ ID NO: 5193 - protein, 13 aa, Artificial Sequence
  Synthetic Peptide
FKSYKLDDTQASR

SEQ ID NO: 5194 - protein, 13 aa, Artificial Sequence
  Synthetic Peptide
EQHLFLPFSYKNK

SEQ ID NO: 5195 - protein, 25 aa, Artificial Sequence
  Synthetic Peptide
YAGYSFEKLFPDVLFPADSEHNKLK

SEQ ID NO: 5196 - protein, 30 aa, Artificial Sequence
  Synthetic Peptide
AEEYAQQDVLKKSYSKAFTLTISALFVTPK

SEQ ID NO: 5197 - protein, 22 aa, Artificial Sequence
  Synthetic Peptide
TALEHQEYITFLEDLKSFVKSQ

SEQ ID NO: 5198 - protein, 14 aa, Artificial Sequence
  Synthetic Peptide
LPDRDGKRCMFCVK

SEQ ID NO: 5199 - protein, 32 aa, Artificial Sequence
  Synthetic Peptide
GAGDGANWLTFFCQPVKSWNGLILRKPIDMEK

SEQ ID NO: 5200 - protein, 17 aa, Artificial Sequence
  Synthetic Peptide
IPEENIATMKYGAQVVK

SEQ ID NO: 5201 - protein, 31 aa, Artificial Sequence
  Synthetic Peptide
YSVGLLDMTKEKEFFDVWSVLMGESQPYSGP

SEQ ID NO: 5202 - protein, 45 aa, Artificial Sequence
  Synthetic Peptide
NITKTFKINGSANFSFNDEEMKNVMDSSNGLSEYLDLSSPGPVEI

SEQ ID NO: 5203 - protein, 18 aa, Artificial Sequence
  Synthetic Peptide
PDWPSAKQLLGDSNFLKR

SEQ ID NO: 5204 - protein, 13 aa, Artificial Sequence
  Synthetic Peptide
LSFKSELGTAETK

SEQ ID NO: 5205 - protein, 39 aa, Artificial Sequence
  Synthetic Peptide
INKKTGQPEELVSCSDCGRSGHPSCLQFTPVMMAAVKTY

SEQ ID NO: 5206 - protein, 34 aa, Artificial Sequence
  Synthetic Peptide
VHTECCHGDLLECADDRADLAKYICENQDSISSK

SEQ ID NO: 5207 - protein, 35 aa, Artificial Sequence
  Synthetic Peptide
KYSDASDCHGEDSQAFCEKFSGQLNSHGCFYQQVK

SEQ ID NO: 5208 - protein, 21 aa, Artificial Sequence
  Synthetic Peptide
IKLVDVDKLSLPQDTGTFISK

SEQ ID NO: 5209 - protein, 11 aa, Artificial Sequence
  Synthetic Peptide
NANFKFTDHLK

SEQ ID NO: 5210 - protein, 14 aa, Artificial Sequence
  Synthetic Peptide
EHITNEKQKLFTSK

SEQ ID NO: 5211 - protein, 18 aa, Artificial Sequence
  Synthetic Peptide
HSKLSSCVAALVALQAKR

SEQ ID NO: 5212 - protein, 20 aa, Artificial Sequence
  Synthetic Peptide
FTDHLKYVMLPVADQDQCIR

SEQ ID NO: 5213 - protein, 26 aa, Artificial Sequence
  Synthetic Peptide
SMGGKEDLIWELLNQAQEHFGKDKSK

SEQ ID NO: 5214 - protein, 11 aa, Artificial Sequence
  Synthetic Peptide
DKPYECEECDK

SEQ ID NO: 5215 - protein, 14 aa, Artificial Sequence
  Synthetic Peptide
YICENQDSISSKLK

SEQ ID NO: 5216 - protein, 39 aa, Artificial Sequence
  Synthetic Peptide
LKECCEKPLLEKSHCIAEVENDEMPADLPSLAADFVESK

SEQ ID NO: 5217 - protein, 34 aa, Artificial Sequence
  Synthetic Peptide
GGFNWGLHFKWDLVPLSELGRAEGATAPIKSPTM

SEQ ID NO: 5218 - protein, 48 aa, Artificial Sequence
  Synthetic Peptide
EADDDSVDPFWPALHCFMVILDRLGSKVWGQLMDPIVAFQTIINNASY

SEQ ID NO: 5219 - protein, 11 aa, Artificial Sequence
  Synthetic Peptide
KKSASSGEMSK

SEQ ID NO: 5220 - protein, 14 aa, Artificial Sequence
  Synthetic Peptide
AVISLMEMGFDEKE

SEQ ID NO: 5221 - protein, 16 aa, Artificial Sequence
  Synthetic Peptide
GNTAKCTSTGWIPAPR

SEQ ID NO: 5222 - protein, 12 aa, Artificial Sequence
  Synthetic Peptide
LKECCEKPLLEK

SEQ ID NO: 5223 - protein, 42 aa, Artificial Sequence
  Synthetic Peptide
LILSEDIDPHKNFVALNYDGICYLGGFEYGRKVNIVTQEIFK

SEQ ID NO: 5224 - protein, 26 aa, Artificial Sequence
  Synthetic Peptide
RKEYEMKLHTEAQIQEEGTVVELTGR

SEQ ID NO: 5225 - protein, 8 aa, Artificial Sequence
  Synthetic Peptide
VQVVAGKK

SEQ ID NO: 5226 - protein, 24 aa, Artificial Sequence
  Synthetic Peptide
MPKIKMPKISMPGFKGEGPEVDVN

SEQ ID NO: 5227 - protein, 26 aa, Artificial Sequence
  Synthetic Peptide
RKEYEMKLHTEAQIQEEGTVVELTGR

SEQ ID NO: 5228 - protein, 26 aa, Artificial Sequence
  Synthetic Peptide
GLEGPKGEVGAPGSKGEAGPTGPMGA

SEQ ID NO: 5229 - protein, 11 aa, Artificial Sequence
  Synthetic Peptide
KVKELCAKAEK

SEQ ID NO: 5230 - protein, 11 aa, Artificial Sequence
  Synthetic Peptide
HYEGSTVPEKK

SEQ ID NO: 5231 - protein, 14 aa, Artificial Sequence
  Synthetic Peptide
HYEGSTVPEKKTPK

SEQ ID NO: 5232 - protein, 17 aa, Artificial Sequence
  Synthetic Peptide
DLLFKDSAHGFLKVPPR

SEQ ID NO: 5233 - protein, 20 aa, Artificial Sequence
  Synthetic Peptide
LSITGTYDLKSVLGQLGITK

SEQ ID NO: 5234 - protein, 14 aa, Artificial Sequence
  Synthetic Peptide
HYEGSTVPEKKTPK

SEQ ID NO: 5235 - protein, 19 aa, Artificial Sequence
  Synthetic Peptide
SAMLIMAEEKALAMGYKPK

SEQ ID NO: 5236 - protein, 16 aa, Artificial Sequence
  Synthetic Peptide
MDAKMYLGYEYVTAIR

SEQ ID NO: 5237 - protein, 15 aa, Artificial Sequence
  Synthetic Peptide
TWILSSNKDVGIWLK

SEQ ID NO: 5238 - protein, 40 aa, Artificial Sequence
  Synthetic Peptide
PSTQGHHWPHGITIVTPDRKFLFACETESDQREWVAAFQK

SEQ ID NO: 5239 - protein, 31 aa, Artificial Sequence
  Synthetic Peptide
DQFNLIVFSTEATQWRPSLVPASAENVNKAR

SEQ ID NO: 5240 - protein, 31 aa, Artificial Sequence
  Synthetic Peptide
SHCIAEVENDEMPADLPSLAADFVESKDVCK

SEQ ID NO: 5241 - protein, 22 aa, Artificial Sequence
  Synthetic Peptide
HTFMGVVSLGSPSGEVSHPRKT

SEQ ID NO: 5242 - protein, 33 aa, Artificial Sequence
  Synthetic Peptide
CSLEDLKLAKSLVPKALEGYITDISTGPSWLNQ

SEQ ID NO: 5243 - protein, 30 aa, Artificial Sequence
  Synthetic Peptide
LVAKLDLNLCQQVNDVWNFKMTGRYEMYAR

SEQ ID NO: 5244 - protein, 21 aa, Artificial Sequence
  Synthetic Peptide
LLEREIKALLTPEDYQRFLDL

SEQ ID NO: 5245 - protein, 34 aa, Artificial Sequence
  Synthetic Peptide
SDIILAFQDAGLPLKHKFGKVEDSLELSFQGKDD

SEQ ID NO: 5246 - protein, 11 aa, Artificial Sequence
  Synthetic Peptide
VMDKYTFELSR

SEQ ID NO: 5247 - protein, 13 aa, Artificial Sequence
  Synthetic Peptide
LKFDPELLFNKQF

SEQ ID NO: 5248 - protein, 37 aa, Artificial Sequence
  Synthetic Peptide
SHCIAEVENDEMPADLPSLAADFVESKDVCKNYAEAK

SEQ ID NO: 5249 - protein, 28 aa, Artificial Sequence
  Synthetic Peptide
RLEKEVGTPHGIILDSVDAAFICPGSSR

SEQ ID NO: 5250 - protein, 9 aa, Artificial Sequence
  Synthetic Peptide
TITKLSFVK

SEQ ID NO: 5251 - protein, 22 aa, Artificial Sequence
  Synthetic Peptide
CHPGYKPTTDEPTTVICQKNLR

SEQ ID NO: 5252 - protein, 21 aa, Artificial Sequence
  Synthetic Peptide
VFSNGADLSGVTEEAPLKLSK

SEQ ID NO: 5253 - protein, 11 aa, Artificial Sequence
  Synthetic Peptide
LSFVKVDSHFR

SEQ ID NO: 5254 - protein, 25 aa, Artificial Sequence
  Synthetic Peptide
VFSNGADLSGVTEEAPLKLSKAVHK

SEQ ID NO: 5255 - protein, 19 aa, Artificial Sequence
  Synthetic Peptide
SGIPIVTSPYQIHFTKTPK

SEQ ID NO: 5256 - protein, 25 aa, Artificial Sequence
  Synthetic Peptide
GKNSSYVHGGLDSNGKPADAVYGQK

SEQ ID NO: 5257 - protein, 19 aa, Artificial Sequence
  Synthetic Peptide
SGIPIVTSPYQIHFTKTPK

SEQ ID NO: 5258 - protein, 25 aa, Artificial Sequence
  Synthetic Peptide
EGTCPEAPTDECKPVKWCALSHHER

SEQ ID NO: 5259 - protein, 30 aa, Artificial Sequence
  Synthetic Peptide
YWLGLENIYWLTNQGNYKLLVTMEDWSGRK

SEQ ID NO: 5260 - protein, 25 aa, Artificial Sequence
  Synthetic Peptide
QSSTLTTHKIIHAGEKPYKCEECGK

SEQ ID NO: 5261 - protein, 11 aa, Artificial Sequence
  Synthetic Peptide
WKPVAPMLKPR

SEQ ID NO: 5262 - protein, 37 aa, Artificial Sequence
  Synthetic Peptide
GFGNIDGEYWLGLENIYMLSNQDNYKLLIELEDWSDK

SEQ ID NO: 5263 - protein, 15 aa, Artificial Sequence
  Synthetic Peptide
IYISGMAPRPSLAKK

SEQ ID NO: 5264 - protein, 30 aa, Artificial Sequence
  Synthetic Peptide
AVLTIDEKGTEAAGAMFLEAIPMSIPPEVK

SEQ ID NO: 5265 - protein, 58 aa, Artificial Sequence
  Synthetic Peptide
IPNAAAAAAAAAAGRVGMPGVSAGGNTVLLVSNLNEEMVTPQSLFTLFGVYGDVQRVK

SEQ ID NO: 5266 - protein, 20 aa, Artificial Sequence
  Synthetic Peptide
WCAVSEHEATKCQSFRDHMK

SEQ ID NO: 5267 - protein, 12 aa, Artificial Sequence
  Synthetic Peptide
VLADKFIIPGLK

SEQ ID NO: 5268 - protein, 23 aa, Artificial Sequence
  Synthetic Peptide
EIVKYLLNQGADVTLRAKNGYTA

SEQ ID NO: 5269 - protein, 22 aa, Artificial Sequence
  Synthetic Peptide
KMAVGMILACLAFAVAAAVEIK

SEQ ID NO: 5270 - protein, 18 aa, Artificial Sequence
  Synthetic Peptide
ALKKDVVLIDDDVECTMV

SEQ ID NO: 5271 - protein, 21 aa, Artificial Sequence
  Synthetic Peptide
TYETTLEKCCAAADPHECYAK

SEQ ID NO: 5272 - protein, 28 aa, Artificial Sequence
  Synthetic Peptide
LKCDEWSVNSVGKIECVSAETTEDCIAK

SEQ ID NO: 5273 - protein, 37 aa, Artificial Sequence
  Synthetic Peptide
NTIFTNVAETSDGGVYWEGIDEPLASGVTITSWKNKE

SEQ ID NO: 5274 - protein, 18 aa, Artificial Sequence
  Synthetic Peptide
NIDLGPTILDIAGYDLNK

SEQ ID NO: 5275 - protein, 19 aa, Artificial Sequence
  Synthetic Peptide
RVVPDHYCHYYPENVKPKP

SEQ ID NO: 5276 - protein, 20 aa, Artificial Sequence
  Synthetic Peptide
AIMEKLEMSKFQPTLLTLPR

SEQ ID NO: 5277 - protein, 17 aa, Artificial Sequence
  Synthetic Peptide
SCLPASGSMCGSLIESK

SEQ ID NO: 5278 - protein, 14 aa, Artificial Sequence
  Synthetic Peptide
EKPSGEEPPVEAKR

SEQ ID NO: 5279 - protein, 30 aa, Artificial Sequence
  Synthetic Peptide
CCAAADPHECYAKVFDEFKPLVEEPQNLIK

SEQ ID NO: 5280 - protein, 12 aa, Artificial Sequence
  Synthetic Peptide
ELKVQMKTIQLK

SEQ ID NO: 5281 - protein, 16 aa, Artificial Sequence
  Synthetic Peptide
AHLNIKSPAFTDLHLR

SEQ ID NO: 5282 - protein, 38 aa, Artificial Sequence
  Synthetic Peptide
QPPDSGPMCDLLWSDPQPQNGRSISKRGVSCQFGPDVT

SEQ ID NO: 5283 - protein, 20 aa, Artificial Sequence
  Synthetic Peptide
ECGKSFTFRSGLIGHQAIHT

SEQ ID NO: 5284 - protein, 22 aa, Artificial Sequence
  Synthetic Peptide
SMVMGTKDTMSTGLTGAANVAK

SEQ ID NO: 5285 - protein, 25 aa, Artificial Sequence
  Synthetic Peptide
SGAQATWTELPWPHEKVDGALCMEK

SEQ ID NO: 5286 - protein, 22 aa, Artificial Sequence
  Synthetic Peptide
FNKPFVFLMIEQNTKSPLFMGK

SEQ ID NO: 5287 - protein, 9 aa, Artificial Sequence
  Synthetic Peptide
LTIFKTELR

SEQ ID NO: 5288 - protein, 35 aa, Artificial Sequence
  Synthetic Peptide
IYHGVPMVGVPIFGDQLDNIAHMKAKGAAVEINFK

SEQ ID NO: 5289 - protein, 34 aa, Artificial Sequence
  Synthetic Peptide
VKVGNEYVTKGQNVQQVTNSVGALAKAVYEKMFL

SEQ ID NO: 5290 - protein, 10 aa, Artificial Sequence
  Synthetic Peptide
QEDASKRKAE

SEQ ID NO: 5291 - protein, 31 aa, Artificial Sequence
  Synthetic Peptide
KGLSHVAMGQFYEGIKAQTKVMLNDPLPGQK

SEQ ID NO: 5292 - protein, 44 aa, Artificial Sequence
  Synthetic Peptide
LIDLTDHTGTLHSCSLTGSVAEETLGCTVHEFLAMTDEQKTALK

SEQ ID NO: 5293 - protein, 17 aa, Artificial Sequence
  Synthetic Peptide
LSINTHPSQKPLSITVR

SEQ ID NO: 5294 - protein, 8 aa, Artificial Sequence
  Synthetic Peptide
SQILKNVR

SEQ ID NO: 5295 - protein, 21 aa, Artificial Sequence
  Synthetic Peptide
TTIIGKFCTALLPVNDREKMV

SEQ ID NO: 5296 - protein, 26 aa, Artificial Sequence
  Synthetic Peptide
ELSSFIDKGQELCADYSENTFTEYKK

SEQ ID NO: 5297 - protein, 17 aa, Artificial Sequence
  Synthetic Peptide
DYSENTFTEYKKKLAER

SEQ ID NO: 5298 - protein, 23 aa, Artificial Sequence
  Synthetic Peptide
AVDAALKKYNSQNQSNNQFVLYR

SEQ ID NO: 5299 - protein, 28 aa, Artificial Sequence
  Synthetic Peptide
AKNMPDPITARESIWLPFMETELHCDEK

SEQ ID NO: 5300 - protein, 31 aa, Artificial Sequence
  Synthetic Peptide
KYPNKYESIIATLCENLDSLDEPDARAAMIW

SEQ ID NO: 5301 - protein, 8 aa, Artificial Sequence
  Synthetic Peptide
SICKMLLT

SEQ ID NO: 5302 - protein, 7 aa, Artificial Sequence
  Synthetic Peptide
IGGSYKK

SEQ ID NO: 5303 - protein, 6 aa, Artificial Sequence
  Synthetic Peptide
SYGTVK

SEQ ID NO: 5304 - protein, 17 aa, Artificial Sequence
  Synthetic Peptide
NVAMAMGAQLIGKFEAK

SEQ ID NO: 5305 - protein, 43 aa, Artificial Sequence
  Synthetic Peptide
NSLRLYRSFYGGLADQLCANELAAADGLPCWNGEDIVKSYTQR

SEQ ID NO: 5306 - protein, 21 aa, Artificial Sequence
  Synthetic Peptide
QNCELFEQLGEYKFQNALLVR

SEQ ID NO: 5307 - protein, 6 aa, Artificial Sequence
  Synthetic Peptide
VNYKDR

SEQ ID NO: 5308 - protein, 35 aa, Artificial Sequence
  Synthetic Peptide
MIDISLDGFLLTPVQKICKYPLQLAELLKYTHPQH

SEQ ID NO: 5309 - protein, 23 aa, Artificial Sequence
  Synthetic Peptide
AVDAALKKYNSQNQSNNQFVLYR

SEQ ID NO: 5310 - protein, 25 aa, Artificial Sequence
  Synthetic Peptide
LCHYNLPESAPLIYNSFAQFLVKEK

SEQ ID NO: 5311 - protein, 14 aa, Artificial Sequence
  Synthetic Peptide
TLAWSTSKPASAGK

SEQ ID NO: 5312 - protein, 10 aa, Artificial Sequence
  Synthetic Peptide
RHDWGHEKQR

SEQ ID NO: 5313 - protein, 46 aa, Artificial Sequence
  Synthetic Peptide
MCTSMAVAASVMGGVVQASLSIHGMCGGPMLGLFSLGIVFPFVNWK

SEQ ID NO: 5314 - protein, 18 aa, Artificial Sequence
  Synthetic Peptide
YTKKVPQVSTPTLVEVSR

SEQ ID NO: 5315 - protein, 10 aa, Artificial Sequence
  Synthetic Peptide
FKDLGEENFK

SEQ ID NO: 5316 - protein, 35 aa, Artificial Sequence
  Synthetic Peptide
SLGPNSCSANGPGLYLIHGPNLYCYSDVEKLNAAK

SEQ ID NO: 5317 - protein, 16 aa, Artificial Sequence
  Synthetic Peptide
NIEKISMLEKIYIHPR

SEQ ID NO: 5318 - protein, 19 aa, Artificial Sequence
  Synthetic Peptide
KIINGIVQKQDTITEESEK

SEQ ID NO: 5319 - protein, 35 aa, Artificial Sequence
  Synthetic Peptide
KHRVLKEVEAVIPDHCIFASNTSALPISEIAAVSK

SEQ ID NO: 5320 - protein, 8 aa, Artificial Sequence
  Synthetic Peptide
NLGKVGSK

SEQ ID NO: 5321 - protein, 31 aa, Artificial Sequence
  Synthetic Peptide
CIGEGQFGDVHQGIYMSPENPALAVAIKTCK

SEQ ID NO: 5322 - protein, 7 aa, Artificial Sequence
  Synthetic Peptide
VGSKCCK

SEQ ID NO: 5323 - protein, 16 aa, Artificial Sequence
  Synthetic Peptide
NLGKVGSKCCKHPEAK

SEQ ID NO: 5324 - protein, 13 aa, Artificial Sequence
  Synthetic Peptide
VGSKCCKHPEAKR

SEQ ID NO: 5325 - protein, 8 aa, Artificial Sequence
  Synthetic Peptide
CCKHPEAK

SEQ ID NO: 5326 - protein, 14 aa, Artificial Sequence
  Synthetic Peptide
SASDLTWDNLKGKK

SEQ ID NO: 5327 - protein, 14 aa, Artificial Sequence
  Synthetic Peptide
SASDLTWDNLKGKK

SEQ ID NO: 5328 - protein, 9 aa, Artificial Sequence
  Synthetic Peptide
CCKHPEAKR

SEQ ID NO: 5329 - protein, 19 aa, Artificial Sequence
  Synthetic Peptide
PTPAPTSGIVGALMEVMQK

SEQ ID NO: 5330 - protein, 24 aa, Artificial Sequence
  Synthetic Peptide
TAQTTWKGLWMSCVVQSTGHMQCK

SEQ ID NO: 5331 - protein, 20 aa, Artificial Sequence
  Synthetic Peptide
SLLKRMLKCLIFEGLVKQIK

SEQ ID NO: 5332 - protein, 13 aa, Artificial Sequence
  Synthetic Peptide
IYGNQDTSSQLKK

SEQ ID NO: 5333 - protein, 43 aa, Artificial Sequence
  Synthetic Peptide
FFYNHCMHVLTAPLLTNTSEDKCEKDNIVGSNKNNTICPGALR

SEQ ID NO: 5334 - protein, 36 aa, Artificial Sequence
  Synthetic Peptide
SFVHLEPMSHELPCGHTQTVQAHYILNGGTLLGLKK

SEQ ID NO: 5335 - protein, 36 aa, Artificial Sequence; identical to SEQ ID NO: 5334
  Synthetic Peptide

SEQ ID NO: 5336 - protein, 11 aa, Artificial Sequence
  Synthetic Peptide
YYTYLIMNKGR

SEQ ID NO: 5337 - protein, 24 aa, Artificial Sequence
  Synthetic Peptide
KGDNSSMDDLHKKDAGMFQAQDER

SEQ ID NO: 5338 - protein, 18 aa, Artificial Sequence
  Synthetic Peptide
TPVSDRVTKCCTESLVNR

SEQ ID NO: 5339 - protein, 30 aa, Artificial Sequence
  Synthetic Peptide
HLEKQEAQLELPEQQVGQPKHLEQQEKHLE

SEQ ID NO: 5340 - protein, 23 aa, Artificial Sequence
  Synthetic Peptide
KEKTEVEPFENIEVYNLMCDLLR

SEQ ID NO: 5341 - protein, 20 aa, Artificial Sequence
  Synthetic Peptide
INHCRFDEFFSEGCAPGSKK

SEQ ID NO: 5342 - protein, 44 aa, Artificial Sequence
  Synthetic Peptide
EALERMEKLLETIDQLHLEFAKRAAPFNNWMEGAMEDLQDMFIV

SEQ ID NO: 5343 - protein, 15 aa, Artificial Sequence
  Synthetic Peptide
FDEFFSEGCAPGSKK

SEQ ID NO: 5344 - protein, 29 aa, Artificial Sequence
  Synthetic Peptide
NTEILTGSWSDQTYPEGTQAIYKCRPGYR

SEQ ID NO: 5345 - protein, 14 aa, Artificial Sequence
  Synthetic Peptide
ELWGMFKTFPYQHR

SEQ ID NO: 5346 - protein, 27 aa, Artificial Sequence
  Synthetic Peptide
GEPGRDGDKGDRGLPGFPGLHGMPGSK

SEQ ID NO: 5347 - protein, 32 aa, Artificial Sequence
  Synthetic Peptide
DSSLCKLCMGSGLNLCEPNNKEGYYGYTGAFR

SEQ ID NO: 5348 - protein, 42 aa, Artificial Sequence
  Synthetic Peptide
ILPVYEQGSHFQPSTVEMVDGETSPPKLLTEADLIALMEKHG

SEQ ID NO: 5349 - protein, 32 aa, Artificial Sequence
  Synthetic Peptide
TGTHGLLVKQEDMKGHFSISIPVKSDIAPVAR

SEQ ID NO: 5350 - protein, 32 aa, Artificial Sequence; identical to SEQ ID NO: 5349
  Synthetic Peptide

SEQ ID NO: 5351 - protein, 13 aa, Artificial Sequence
  Synthetic Peptide
CGKAFNQSSKLTK

SEQ ID NO: 5352 - protein, 26 aa, Artificial Sequence
  Synthetic Peptide
AGLEKNYCRNPDGDVGGPWCYTTNPR

SEQ ID NO: 5353 - protein, 8 aa, Artificial Sequence
  Synthetic Peptide
YQCKNYYK

SEQ ID NO: 5354 - protein, 18 aa, Artificial Sequence
  Synthetic Peptide
GHFSISIPVKSDIAPVAR

SEQ ID NO: 5355 - protein, 33 aa, Artificial Sequence
  Synthetic Peptide
ALEAKDIFAVEYGIPKHFGLFYAMGIALMMEGV

SEQ ID NO: 5356 - protein, 10 aa, Artificial Sequence
  Synthetic Peptide
EKLEKPEKEK

SEQ ID NO: 5357 - protein, 12 aa, Artificial Sequence
  Synthetic Peptide
CLVEKGDVAFVK

SEQ ID NO: 5358 - protein, 13 aa, Artificial Sequence
  Synthetic Peptide
QIKKQTALVELVK

SEQ ID NO: 5359 - protein, 14 aa, Artificial Sequence
  Synthetic Peptide
TWPHFTATVKPRPA

SEQ ID NO: 5360 - protein, 20 aa, Artificial Sequence
  Synthetic Peptide
VKSVINLLFAAYTGDVSALR

SEQ ID NO: 5361 - protein, 33 aa, Artificial Sequence
  Synthetic Peptide
AWNVHGAQSGSVFQLLPGKLEHGGGLGLGAALG

SEQ ID NO: 5362 - protein, 45 aa, Artificial Sequence
  Synthetic Peptide
NGMKGEKGDSGMPGPQGPSIIGPPGPPGPHGPPGPMGPHGLPGPK

SEQ ID NO: 5363 - protein, 13 aa, Artificial Sequence
  Synthetic Peptide
QTALVELVKHKPK

SEQ ID NO: 5364 - protein, 16 aa, Artificial Sequence
  Synthetic Peptide
QTALVELVKHKPKATK

SEQ ID NO: 5365 - protein, 20 aa, Artificial Sequence
  Synthetic Peptide
APKDKPESKKSGLLWFWLPN

SEQ ID NO: 5366 - protein, 23 aa, Artificial Sequence
  Synthetic Peptide
HKPKATKEQLKAVMDDFAAFVEK

SEQ ID NO: 5367 - protein, 19 aa, Artificial Sequence
  Synthetic Peptide
ATKEQLKAVMDDFAAFVEK

SEQ ID NO: 5368 - protein, 16 aa, Artificial Sequence
  Synthetic Peptide
AVVPGVKPQDWISAAR

SEQ ID NO: 5369 - protein, 29 aa, Artificial Sequence
  Synthetic Peptide
NLNEKDYELLCLDGTRKPVEEYANCHLAR

SEQ ID NO: 5370 - protein, 16 aa, Artificial Sequence
  Synthetic Peptide
CVDLLVGPGAAQAAIK

SEQ ID NO: 5371 - protein, 13 aa, Artificial Sequence
  Synthetic Peptide
QQLNFTEAKEACR

SEQ ID NO: 5372 - protein, 29 aa, Artificial Sequence
  Synthetic Peptide
AVMDDFAAFVEKCCKADDKETCFAEEGKK

SEQ ID NO: 5373 - protein, 29 aa, Artificial Sequence
  Synthetic Peptide
AVMDDFAAFVEKCCKADDKETCFAEEGKK

SEQ ID NO: 5374 - protein, 17 aa, Artificial Sequence
  Synthetic Peptide
NQKMYEASIKDSDVEGG

SEQ ID NO: 5375 - protein, 20 aa, Artificial Sequence
  Synthetic Peptide
LKYGQTIRPICLPCTEGTTR

SEQ ID NO: 5376 - protein, 16 aa, Artificial Sequence
  Synthetic Peptide
ISKPPMGTWMGLLNNK

SEQ ID NO: 5377 - protein, 14 aa, Artificial Sequence
  Synthetic Peptide
ADDKETCFAEEGKK

SEQ ID NO: 5378 - protein, 25 aa, Artificial Sequence
  Synthetic Peptide
ADDKETCFAEEGKKLVAASQAALGL

SEQ ID NO: 5379 - protein, 17 aa, Artificial Sequence
  Synthetic Peptide
FRYQVMSGPHETLKQLR

SEQ ID NO: 5380 - protein, 15 aa, Artificial Sequence
  Synthetic Peptide
SVIPSDGPSVACVKK

SEQ ID NO: 5381 - protein, 9 aa, Artificial Sequence
  Synthetic Peptide
KTKAPPLSK

SEQ ID NO: 5382 - protein, 39 aa, Artificial Sequence
  Synthetic Peptide
KQQGLEENHELFSKSFISMEVPVMVVNGKDDMHDVEDEL

SEQ ID NO: 5383 - protein, 16 aa, Artificial Sequence
  Synthetic Peptide
VVLVAVDKGVFVLNKK

SEQ ID NO: 5384 - protein, 45 aa, Artificial Sequence
  Synthetic Peptide
HCGYSKAFQDSDEEKMHYQNGQAPPPVFLPLHHPPGKLPEPQFYA

SEQ ID NO: 5385 - protein, 10 aa, Artificial Sequence
  Synthetic Peptide
SLAPTAAAKR

SEQ ID NO: 5386 - protein, 16 aa, Artificial Sequence
  Synthetic Peptide
VVLVAVDKGVFVLNKK

SEQ ID NO: 5387 - protein, 16 aa, Artificial Sequence
  Synthetic Peptide
VVLVAVDKGVFVLNKK

SEQ ID NO: 5388 - protein, 15 aa, Artificial Sequence
  Synthetic Peptide
SVIPSDGPSVACVKK

SEQ ID NO: 5389 - protein, 23 aa, Artificial Sequence
  Synthetic Peptide
VVLVAVDKGVFVLNKKNKLTQSK

SEQ ID NO: 5390 - protein, 18 aa, Artificial Sequence
  Synthetic Peptide
APNHAVVTRKDKEACVHK

SEQ ID NO: 5391 - protein, 9 aa, Artificial Sequence
  Synthetic Peptide
KDKEACVHK

SEQ ID NO: 5392 - protein, 11 aa, Artificial Sequence
  Synthetic Peptide
DKEACVHKILR

SEQ ID NO: 5393 - protein, 38 aa, Artificial Sequence
  Synthetic Peptide
LETPDFQLFKNGVAQEPVHLDSPAIKHQFLLTGDTQGR

SEQ ID NO: 5394 - protein, 49 aa, Artificial Sequence
  Synthetic Peptide
KGEDIFLDMFEDEYRSMTMKPMNVEYLMMDASILLPPTGTPLTGIDFVK

SEQ ID NO: 5395 - protein, 17 aa, Artificial Sequence
  Synthetic Peptide
NVHSGSTFFKYYLQGAK

SEQ ID NO: 5396 - protein, 19 aa, Artificial Sequence
  Synthetic Peptide
LIQHSGAKKASASGQAQNK

SEQ ID NO: 5397 - protein, 16 aa, Artificial Sequence
  Synthetic Peptide
QLMKVDGGEVVKFLQD

SEQ ID NO: 5398 - protein, 21 aa, Artificial Sequence
  Synthetic Peptide
LSLCEKGDAMIMEETGKIFKK

SEQ ID NO: 5399 - protein, 28 aa, Artificial Sequence
  Synthetic Peptide
EDTDNSSLSPPPDVTLSLLPSNETEKTK

SEQ ID NO: 5400 - protein, 33 aa, Artificial Sequence
  Synthetic Peptide
MVPLGDSHSLKKDPVMPQNMVPLEDSNSHSLKK

SEQ ID NO: 5401 - protein, 39 aa, Artificial Sequence
  Synthetic Peptide
ESDEKAGKIFSQMNNIMSKSLHDDGFTVPQIIEMELDSQ

SEQ ID NO: 5402 - protein, 47 aa, Artificial Sequence
  Synthetic Peptide
TTVSDFGQSHLTEEKVISDCECVPQKHVLTSHIDEPPTQNQSDLLNK

SEQ ID NO: 5403 - protein, 30 aa, Artificial Sequence
  Synthetic Peptide
DLLFRDDTVCLAKLHDRNTYEKYLGEEYVK

SEQ ID NO: 5404 - protein, 39 aa, Artificial Sequence
  Synthetic Peptide
SSVSRRPLHSMPLYPPDYLIDPQILLCDYLEKEVKFLGH

SEQ ID NO: 5405 - protein, 21 aa, Artificial Sequence
  Synthetic Peptide
LQHLPYQLMEVKAMKLFDASR

SEQ ID NO: 5406 - protein, 15 aa, Artificial Sequence
  Synthetic Peptide
KKLGKLGRQVLPPSE

SEQ ID NO: 5407 - protein, 17 aa, Artificial Sequence
  Synthetic Peptide
LHDRNTYEKYLGEEYVK

SEQ ID NO: 5408 - protein, 25 aa, Artificial Sequence
  Synthetic Peptide
KSTKKEIFELMQTDLEMVTEDLAQK

SEQ ID NO: 5409 - protein, 19 aa, Artificial Sequence
  Synthetic Peptide
NIATEIKDGLQCGTVSSQK

SEQ ID NO: 5410 - protein, 32 aa, Artificial Sequence
  Synthetic Peptide
NCGGGHRSWAFSDTEAAMAFAYLKDGDVMLYR

SEQ ID NO: 5411 - protein, 14 aa, Artificial Sequence
  Synthetic Peptide
YLGEEYVKAVGNLR

SEQ ID NO: 5412 - protein, 8 aa, Artificial Sequence
  Synthetic Peptide
SVQLTEKR

SEQ ID NO: 5413 - protein, 25 aa, Artificial Sequence
  Synthetic Peptide
VIPAADLSEQISTAGTEASGTGNMK

SEQ ID NO: 5414 - protein, 8 aa, Artificial Sequence
  Synthetic Peptide
AFTNSKIR

SEQ ID NO: 5415 - protein, 6 aa, Artificial Sequence
  Synthetic Peptide
VGKYPK

SEQ ID NO: 5416 - protein, 9 aa, Artificial Sequence
  Synthetic Peptide
SSSMTTLAK

SEQ ID NO: 5417 - protein, 16 aa, Artificial Sequence
  Synthetic Peptide
SYFEKSKEQLTPLIKK

SEQ ID NO: 5418 - protein, 15 aa, Artificial Sequence
  Synthetic Peptide
AINEKLGQYASPTAK

SEQ ID NO: 5419 - protein, 12 aa, Artificial Sequence
  Synthetic Peptide
IISGQFLSDKKV

SEQ ID NO: 5420 - protein, 16 aa, Artificial Sequence
  Synthetic Peptide
AINEKLGQYASPTAKR

SEQ ID NO: 5421 - protein, 25 aa, Artificial Sequence
  Synthetic Peptide
DQSPFSKIKQSSQDNELKSSMLKNK

SEQ ID NO: 5422 - protein, 25 aa, Artificial Sequence
  Synthetic Peptide
SQLIVHQRSHTGVKPYGCSECGKAF

SEQ ID NO: 5423 - protein, 26 aa, Artificial Sequence
  Synthetic Peptide
SKDTEQKELDQDMVTEDEDDPGSHKR

SEQ ID NO: 5424 - protein, 12 aa, Artificial Sequence
  Synthetic Peptide
TFSPPPPPPKSR

SEQ ID NO: 5425 - protein, 20 aa, Artificial Sequence
  Synthetic Peptide
LRTEGDGVYTLNDKKQWINK

SEQ ID NO: 5426 - protein, 12 aa, Artificial Sequence
  Synthetic Peptide
TRFISLGEACKK

SEQ ID NO: 5427 - protein, 21 aa, Artificial Sequence
  Synthetic Peptide
GNYDAAQRGPGGVWAAKLISR

SEQ ID NO: 5428 - protein, 23 aa, Artificial Sequence
  Synthetic Peptide
SITCIHGVWTQLPQCVAIDKLKK

SEQ ID NO: 5429 - protein, 9 aa, Artificial Sequence
  Synthetic Peptide
DKGQAGLQR

SEQ ID NO: 5430 - protein, 23 aa, Artificial Sequence
  Synthetic Peptide
VLQVTIPKPALSTLKAQPCKMCS

SEQ ID NO: 5431 - protein, 22 aa, Artificial Sequence
  Synthetic Peptide
GAEVSFGCGVLASGKALVFNKD

SEQ ID NO: 5432 - protein, 23 aa, Artificial Sequence
  Synthetic Peptide
SITCIHGVWTQLPQCVAIDKLKK

SEQ ID NO: 5433 - protein, 41 aa, Artificial Sequence
  Synthetic Peptide
IAEKVQAEKPDIMLGVVCGALNVADAMFRTCMTDFLHSLER

SEQ ID NO: 5434 - protein, 49 aa, Artificial Sequence
  Synthetic Peptide
TLHNWKFWVFSILIRPLFESFNGMVSTASVHTLRQTSLAWLDQYCSLPA

SEQ ID NO: 5435 - protein, 16 aa, Artificial Sequence
  Synthetic Peptide
SYFEKSKEQLTPLIKK

SEQ ID NO: 5436 - protein, 45 aa, Artificial Sequence
  Synthetic Peptide
PGNSSPGLPSSSSPGRDLGAPAGSMGAASCEDEELEFKLVFGEEK

SEQ ID NO: 5437 - protein, 22 aa, Artificial Sequence
  Synthetic Peptide
HMEQQKENMEHLKSLKIEAENK

SEQ ID NO: 5438 - protein, 19 aa, Artificial Sequence
  Synthetic Peptide
FICPLTGLWPINTLKCTPR

SEQ ID NO: 5439 - protein, 17 aa, Artificial Sequence
  Synthetic Peptide
FKTGTTLKYTCLPGYVR

SEQ ID NO: 5440 - protein, 19 aa, Artificial Sequence
  Synthetic Peptide
DDGAPPPGKVVEDWLSLVK

SEQ ID NO: 5441 - protein, 11 aa, Artificial Sequence
  Synthetic Peptide
AAIPSKSRLKR

SEQ ID NO: 5442 - protein, 12 aa, Artificial Sequence
  Synthetic Peptide
SHKWDRELISER

SEQ ID NO: 5443 - protein, 15 aa, Artificial Sequence
  Synthetic Peptide
KLSVLGKDGKPVSEY

SEQ ID NO: 5444 - protein, 25 aa, Artificial Sequence
  Synthetic Peptide
TPSPLVPPGSSPLPPRLSSSPGKTM

SEQ ID NO: 5445 - protein, 47 aa, Artificial Sequence
  Synthetic Peptide
LDVFTMIDIFKYVIYGIAAAFFVYGILLMVEGFFTTGAIKDLYGDFK

SEQ ID NO: 5446 - protein, 31 aa, Artificial Sequence
  Synthetic Peptide
AVGDKLPECEADDGCPKPPEIAHGYVEHSVR

SEQ ID NO: 5447 - protein, 22 aa, Artificial Sequence
  Synthetic Peptide
VGATVTGAGVYYAYKTMKEDEK

SEQ ID NO: 5448 - protein, 16 aa, Artificial Sequence
  Synthetic Peptide
LLDNWDSVTSTFSKLR

SEQ ID NO: 5449 - protein, 10 aa, Artificial Sequence
  Synthetic Peptide
KVEFVLKQLR

SEQ ID NO: 5450 - protein, 30 aa, Artificial Sequence
  Synthetic Peptide
VSVQLEASPAFLAVPVEKEQAPHCICANGR

SEQ ID NO: 5451 - protein, 25 aa, Artificial Sequence
  Synthetic Peptide
ELGCGAASGTPSGILYEPPAEKEQK

SEQ ID NO: 5452 - protein, 32 aa, Artificial Sequence
  Synthetic Peptide
FLSSIGGTLYEVGKPEMQQKINSFLEKEGMEK

SEQ ID NO: 5453 - protein, 32 aa, Artificial Sequence; identical to SEQ ID NO: 5452
  Synthetic Peptide

SEQ ID NO: 5454 - protein, 9 aa, Artificial Sequence
  Synthetic Peptide
VITVKRPLR

SEQ ID NO: 5455 - protein, 14 aa, Artificial Sequence
  Synthetic Peptide
STGSWSTLKTQDQK

SEQ ID NO: 5456 - protein, 17 aa, Artificial Sequence
  Synthetic Peptide
TTIEKPVWLGFLGPIIK

SEQ ID NO: 5457 - protein, 22 aa, Artificial Sequence
  Synthetic Peptide
TKKPGSTVIAGSINAHGSVLIK

SEQ ID NO: 5458 - protein, 38 aa, Artificial Sequence
  Synthetic Peptide
LQWWDFTKFDLPEISNASVNVLVQNCKIYNDASCDISA

SEQ ID NO: 5459 - protein, 17 aa, Artificial Sequence
  Synthetic Peptide
VELLHNPAFCSLATTKR

SEQ ID NO: 5460 - protein, 30 aa, Artificial Sequence
  Synthetic Peptide
TCVADESAENCDKSLHTLFGDKLCTVATLR

SEQ ID NO: 5461 - protein, 9 aa, Artificial Sequence
  Synthetic Peptide
THLELKKLI

SEQ ID NO: 5462 - protein, 14 aa, Artificial Sequence
  Synthetic Peptide
KIIGIMEEVADGFK

SEQ ID NO: 5463 - protein, 38 aa, Artificial Sequence
  Synthetic Peptide
DVLIDFFKERAKLACFDSGDTICKGGEMPQGIYLIISG

SEQ ID NO: 5464 - protein, 45 aa, Artificial Sequence
  Synthetic Peptide
EDDESEGSQGFVEWSKAPQQTTIVLVVCVLFLFLVLTGMPMMFHI

SEQ ID NO: 5465 - protein, 24 aa, Artificial Sequence
  Synthetic Peptide
LITTLLVIPVVVLLAIAIFIRWKK

SEQ ID NO: 5466 - protein, 30 aa, Artificial Sequence
  Synthetic Peptide
EKNDLILQLQAEQETLANVEEQCEWLIKSK

SEQ ID NO: 5467 - protein, 12 aa, Artificial Sequence
  Synthetic Peptide
MYALVQISKHYR

SEQ ID NO: 5468 - protein, 17 aa, Artificial Sequence
  Synthetic Peptide
EFLASYLLKNKAQFEDR

SEQ ID NO: 5469 - protein, 15 aa, Artificial Sequence
  Synthetic Peptide
CISGIFELTDHQKHP

SEQ ID NO: 5470 - protein, 22 aa, Artificial Sequence
  Synthetic Peptide
SSLSVPYVIVPLKTGLQEVEVK

SEQ ID NO: 5471 - protein, 35 aa, Artificial Sequence
  Synthetic Peptide
HLTSTTSSPGVIVPESSENKNLGGVTQESFDLMIK

SEQ ID NO: 5472 - protein, 17 aa, Artificial Sequence
  Synthetic Peptide
STGSWSTLKTQDQKTVR

SEQ ID NO: 5473 - protein, 30 aa, Artificial Sequence
  Synthetic Peptide
TPSYGDLDDCSPKHRNSSPRMPHLAVATDK

SEQ ID NO: 5474 - protein, 21 aa, Artificial Sequence
  Synthetic Peptide
ATLLNQLVEAEHQIMLWEKKI

SEQ ID NO: 5475 - protein, 35 aa, Artificial Sequence
  Synthetic Peptide
FSPTLQTLAGVVNDIGNHLFSTISVFCHLPDILTK

SEQ ID NO: 5476 - protein, 15 aa, Artificial Sequence
  Synthetic Peptide
SLFYSQKFPIQFVWK

SEQ ID NO: 5477 - protein, 17 aa, Artificial Sequence
  Synthetic Peptide
EFLASYLLKNKAQFEDR

SEQ ID NO: 5478 - protein, 13 aa, Artificial Sequence
  Synthetic Peptide
KKANGIFSTAALP

SEQ ID NO: 5479 - protein, 9 aa, Artificial Sequence
  Synthetic Peptide
LKFIIPSPK

SEQ ID NO: 5480 - protein, 28 aa, Artificial Sequence
  Synthetic Peptide
EKEIEVLERGDSAPATAKENAAAPSPVR

SEQ ID NO: 5481 - protein, 32 aa, Artificial Sequence
  Synthetic Peptide
LSWAKPQPLNETAPSNLWKHQKLLSIDLDKVV

SEQ ID NO: 5482 - protein, 10 aa, Artificial Sequence
  Synthetic Peptide
FLHDPIKPCK

SEQ ID NO: 5483 - protein, 19 aa, Artificial Sequence
  Synthetic Peptide
LKHFRVTEGSPVTFTCKIV

SEQ ID NO: 5484 - protein, 27 aa, Artificial Sequence
  Synthetic Peptide
TLLALGCHVGISDEHAEDKVKKMKLPK

SEQ ID NO: 5485 - protein, 25 aa, Artificial Sequence
  Synthetic Peptide
LIHDRNTASHTAAAARTQAPPTPDK

SEQ ID NO: 5486 - protein, 14 aa, Artificial Sequence
  Synthetic Peptide
CLGEKWSHPPSCIK

SEQ ID NO: 5487 - protein, 29 aa, Artificial Sequence
  Synthetic Peptide
EKWSHPPSCIKTDCLSLPSFENAIPMGEK

What is claimed is:

1. An isolated antibody or antigen-binding fragment thereof that specifically binds to a polypeptide comprising a lysine residue when said lysine residue is methylated, and does not bind to said polypeptide when said lysine residue is not methylated, wherein said polypeptide comprises an amino acid sequence selected from the group consisting of SEQ ID NOS: 4386, 4400, 4419, 4422, 4423, 4427, 4430, 4431, 4437, 4443, 4457, 4459, 4477, 4479, 4481, 4483, 4489, 4493, and 4506, and wherein said lysine is the lysine at position 7 in each of the amino acid sequences.

2. The antibody according to claim 1, wherein said antibody or antibody fragment is selected from the group consisting of a polyclonal antibody, a monoclonal antibody or antibody fragment, a recombinant antibody, a camelid antibody, a bispecific antibody, a diabody, a chimerized or chimeric antibody or antibody fragment, a humanized antibody or antibody fragment, a deimmunized human antibody or antibody fragment, a fully human antibody or antibody fragment, a single chain antibody, an Fv, an Fd, an Fab, an Fab', and an F(ab')$_2$.

3. The antibody or antigen-binding fragment thereof according to claim 2, wherein the antibody is a polyclonal antibody.

4. The antibody or antigen-binding fragment thereof according to claim 2, wherein the antibody is a monoclonal antibody.

5. The antibody or antigen-binding fragment thereof according to claim 4, wherein the antibody or antibody fragment is conjugated to a cytotoxic agent.

6. The antibody or antigen-binding fragment thereof according to claim 5, wherein the cytotoxic agent is selected from the group consisting of a radiotherapeutic agent, a ribosome-inactivating protein (RIP), a chemotherapeutic agent, a cytotoxic small molecule, a cytotoxic peptide, and a cytotoxic protein.

7. The antibody or antigen-binding fragment according to claim 1, wherein said polypeptide comprises the amino acid sequence of SEQ ID NO: 4506.

8. The antibody or antigen-binding fragment according to claim 7, wherein the antibody is a polyclonal antibody.

9. The antibody or antigen-binding fragment according to claim 7, wherein the antibody is a monoclonal antibody.

10. The antibody or antigen-binding fragment according to claim 9, wherein the antibody or antibody fragment is conjugated to a cytotoxic agent.

* * * * *